United States Patent 12,648,970 (COMPOSITIONS AND METHODS OF TREATMENT COMPRISING TUMOR-TARGETING BACTERIA AND CHEMOTHERAPY OR IMMUNOTHERAPY AGENT) - sequence listing, part 2

SEQ ID NO: 5 - DNA, 4857399 bp, Salmonella enterica (residues 1,619,134-3,238,266 of 4,857,399)
acaggcccacaatcggcccggacaccgcgccgccgagcggggaaccggcgctaaaaattccgatcgccgtggcagactcctttcgggaaatccagttattgatgattttatttccggcagcgctgaccggcccttcagccataccgaaaagaacgcgcacgataagcattgtccacaatccggtgactaaaccagttaagccacaaaatacagaccatagtaacgctgcgatgagaaaaaccgtttttggcccaactttatcgctggcccagccaccaataaaattaaacagggcgtatccgataaaaaacgcgctgaagatcatccccatctccgcggcgttaaatcctaactccttttcgatcaagggggcagttatcgacaatgctgaacgatccatatagttgagcatgtaaactataaatagaagaaaaacgataagccatcccattgtttttcttttcatgattaatcctcttattgtggtctagcggcctgaccacaatattttaaggttattttcaaatcacctctcttgtggttagaacgtgatcaatataacaaaaatttatcacaggggatttttatccatcgcaagtgtgatggattaaattctttaaaatcagttgattaattgaaaattcaatcggagctatcgttttcccctaatccacgccccggtaaagtttgacatgcggcgttaacggaaggtggcgctgtctgtgggtatttttcatcgggcgtaatataaacctgactcgtggcgacatagccatcattaaaagttgcttcgatataggtagcttcccaacctgtcttcggttcatttagcgtaatactgatcttattgttgacgggactatctattgtaagcggctgatagcggataccacaggcataacgaaaatcacgcgcatttggattgttggctgtccagcgaacgacttttaccggcgcttctgagaaatagaccgtaagaaggtggtggtgaataaggtcgatcaactgtggtaatgtttttttactttgaaaccggttaataaatggaacgaggcttccttcagcgaactggttaattgagtagtggttcatattaggcactatacgtaatgattttacgccaggaagtttgctataataaaagcgagtgttgtctggtacgaaaaaatcatcgccacttgcattaataatatatttaggtattgcaaggcggggttggtaaatagtgttgagatatcttaacggatctattatttgccttagctgggtaaatgcgggggattttattttctcatctatgccttgctggtagtaggggtagaatgtaatgggccaatttccaccgtatgattgataaatatgctcaagtgaagcatcaatatcaagtagatcaatggcgaagggaacaattgcttcaacatcaggatcggcaatagctgacaaccaggtggtccacccacgctttgaaatacctgtaatgataaaggaatttatattccattgcgttaactccttttttgctaatctcatcgcttgcgatatggcagtgaccataggaatatttaaaggcattaacttacgttgctccggcgcttccataaataatgcccagcttcgggaaacgctttcgtcctctttcagtggttttttatcatcctgaaaggttaaatattggttaggtatatcactcactgatattacgatggtattcgtatcacgggagatgcttgccagtgtttcctgggggaaatcaccgggtttaccagtgatttgtacgcctttatcataattaattccgttgtttacaaccaccaaagcatggtgctcttttgccgtttcagggatataaatatcaacgttatgtcgccattgcgcaggggttaccatgtcatctggcgaccagtgttgcgataataattcatagtgtctgactaccacctgtgctaatggagctgtattaatcaaggtatattttagcggtgtgcctgaaatctgctcccggtagtcggggagaacatgagacaaatcacactccgggctgtttcgacaaaagaagatgttgttatgaagtagtgtataaacttttgtagaaatgaaaaacagtacgataacaacgagatatatttttttcatgctttccccgcgctttacaagggcaaatgccagccagcataatttccataaatacctcttaaacattcaatataagtacaatacttttgataaataacggaagaagggaacaataatgtttgtgacgttgtcacattattctgtttctggtttcactattagcactgaactttttgaaaggtaaatcattgccgtcaccagaccaataatggcgacagagatagctataccgatccagacgccatacagagcataacccaggacaaatccgcccaatacgggggatataaaatcagcgattgcgattaatgcctgcgccgttccgatgacgataccttgtcgggcaggcgatacatggacggacaaggcggcaagataagtgggtttggctagcgcatcagcgatgctaatacaaacgatagcaaaaacaagcacaggtatggtcgtggcgatacccgcagtgagaaatccagtacaaagaagggcgaagatgaggataattagctttcgctccgaaaaatattggctcacccaacctaacagaaatagctgaacgaaaatattaataaccccgtccgccattaacagatagcttaacgcttttggcccaaagggaagcccattccagatgaaggtgtcagaaagaaaaacaggtaattgtgaagagtacatgccataggcgaagaaatgacaaagcattacgatgattaagacgcgaaggacaggcatctttaaaatagcgcgggcagagaacgccgctattttatctgtggtacgtgatgttgtggaagggtcttttaacccccaaatcgcgaccagggcagacccaaggacaagtataaaggcggcgtagatcggcgcgctcagactgatacgcgataaccacccggaaacgcctgccccgacaataccgcctaaaccaatgcagcctgtgaggataccgattgcctgacgccgatttctgacgtgcgtacaatcggcaatataggctgcggcggctgacaaattcccggcgctaatgccaaaaagcgtgcgggcgagcaggataaacaggatacattgcgcgttggcgagtaatagtaaacttatcgccgcaatagccagcgtgacaatcagtattcgcttgcggccaacgcgatcggaaaggtggccaatcaggggcgccgcacaaaattggctaaaagcttcagtggcgatgatgattccaatgataagcggcgaaccgcccatctcgcggatataaaaaggcagtaccgacattacagccgcggtactggcggcgtaaaggccgacaagcaggaaaacaggcaaaatacgccgcttgttgagcggggtgatagtttcgctgtcggtgttctcatagacattagtattcatctttaatccctatggcaaaacgagagagataattttcaatatcgttgctctgtttgccgtgaaagaatgcgccgacatagccatcgggtcggatcagcacgcattgacccggcgccagatgataggattcccggaagtgccccagggtatcgatgagctcgtcctgctcgccaatgtgatgaatacgcagtcctcgccgcgcatcgatgaccttaccatgggtttcgtaggccaacagattccagtccggaccttgtagtaactgaaataatcgtaatgattggccgccggcgcccaaaagaggagcatccggagctctttctcccgcttgtaacccatgctgacgttcgggtaacgtgtgggctaagggggagttggtatactggatgtcaagttgttgaacatcgcgttctcgtttgatgcctctctgtttttgagagtcaagtaatcgggtagaaaggtggagcagtgattcggctatcgggcggcgttcctgttcatagctatcgagaagttcttctcctgcgccccgcagcgaggctgccattttccatcccaggttataggcatcctggatgctggtatttaacccttgcccacccgtcggcggatgcacatgagcggcatcaccggctaaaaataccttacccacacggtaatgttccgctatgcgcgcattcatctggtacttcgatacccagggaatcgaatggatgcgaacatccgtccgcccgattcgttcagtaagaaaagccgtgagcacgtcggctgagaaattctgcgagtcgtccggggccaacaacgcctggatttgaaagagctgcgtgccggcgagagggcaaatcgttatcatccgcgccatatcgccatcgttaaaatggtgccatacatcccggttcagaccggaaagtgaagcgtcagccacaagcgcatggattcccaacgtacgaccggggaagctgacgcctaatttttttctgacaaagcttccgccgccatccgcacctatcaaataatgcgcgatgatgacctcttctccagccggcccggcaacatacgcggtgactgtgcgtggggtttgcgcaaaatgtcgtaactcgcagccgaactccacccgatgtccccatgcttttaattgctctcgcataatcgtttctgtcacgttctgtggaaccatcaatggcagatggtagggttcggcgtgggtcggttttgtatgatgcgcaatatctgaatctacatagcttccgtcgtgacggtaggttcgtagtcggggatagagcccgccggcggcgaccactttattgagtattccaagatcctcgaagatttcttgcgttcgcggctgaatacctttaccgcgggagccgataaaaggcgtcgttcttttctcaatcaggcgaaatgagaccccgtgacgcgccagttcgatggctaaagtaagcccggtaacgccagcgccgcagatcagtacatctgtagtggtgtatcttgtcatcgtctctccgatatgtgtattatgcacataagaggagacatgctatgtcagaaaataaaaatgtgcaagatacacatatttccgagcaaatgaaggcgcttcacggtgcgttgattcgcgtggtgagcgcgcttaaccggcctcgtaatgatgagaaattaattgcagaggcggggatacaactcgatcgtgcgctattttcgatccttattagtatcgaacgtttagggccgattggcgttgttgagttagccgaacgtgccggtcgtgattatacgacggtaagccgacaggtcgccaaactggagaagctggggttgataatacggcagcataatgccatcgatcgtcgtatacgcgaggccgttatctcccgtacaggaaaggcgatgacggagcgtatagacgctgcgcgagagcaaatgggcaacgttgtttttaaagactggcctcaggatgaacttgatgtctttgttcggctaatgcaaaagtttgccgatgcaatggatagcgatgcttcaatgccggaataagcaaaagaaaagggcggtcaaatccgatcgtccaggctaatatcggtatctgacattgattaaatagccagcaaagtaaatataacaacaacatttatcgagttaattttcaccctttgaaaggccaacgtatactgcagaatacggctatataacaatcgccgtatcaatggtttttcaaagggtaaatatatgcttaccgaaaaatatgattttcgcattaccgatcagatgactatcccactcagacctcattggatagccaatgattcatacagggaaaagtgtaaaatgcttgtcctcaaccggagtaaaggggaaattcataaggtagactttagtaaattaacagattatatcaaagaaggtgatgtaatctgttttaacgacagtactataataaaccatatgtttatctgtaaaacaagacagaataggttaattaaaattgttttagagggatttttaccaaataatagagtaattatttccggacttttaaaagaaaggcttaacgcgaatgatgttttctatttggttgataaccctgaaatttccattaagatagagcaaaggtttagcgaggagagccagtaccgggccgtcgtggaaaatcatgaggccttaatttgctatttagccagtcatggtgagcgtcttgatgagtatgtggactccagcttgttttataaatatccagatgcttaccgttccgttttttctaaaaaatatggttctttggaaataccttctgccggcattcattttacctgggatcttatccaaagaatcaaagataaaggtgggttaatatccttcatcactttacatgttgcatcaacagaaatgttgtccaacagaaaaatacaaacaaaatgtgtagaggaagtgactatcaacgaagaatactacgaggttccacaagctacagcggatatcattaatactgcgaagcaaaatggcggacgtatttttgccgtaggaactaccgttacacgatgtctggaatctgcgtattcgagggaacacaattgcctcaaagcaagttctggctggactgcgctttatatacatccaggctatcaactgaaagtggttgactgcctgctaacgaacttacatcagccaaaaacgacgcatatggtgttaactggtcagtttgctggggttgatctactcattaaggcctatacctcagaacatatccagtcatgtcagttcgatatgtttggtgattgcatgttaatcatacaagatgaagggcagggatgaataaaataaaaccggtacatataatgctaccggttttaccgagaataagcatcaggggattcgggcaataacctttatttcgaaatcaaagccggccagccaggtaacgccaacagcggtccagttaggataagggggatgggcaaatatctcctgtttcaccgccatcacgtcgttaagttgttgctctggatcggtatggaaggtggtgacatccactatgtcatcgaatgtgcatcctgctgcagtcagtgttgctttcaggttttcaaaagcaagcctcacttgtttttgaaaatcaggctccggcgttccgtctgtgtgactgcctacctggcctgaaacaaacagtaaatcaccagaacggatggctgcggaatacccatgttcctcatacagagaatggcggtcagcaggaaaaaccgcgatacgttgcgtcataatgttatcctcagatagcgtaaacacttcgggcgggaataaaatgaatgtcacatacacaacgtaggccatagtttcatatacgtggcatatgtcaaggtgccgtcacataaaagaactgagcctgtttgtcgtatcgtttgacgggaaagagagcattttctgagtgattagcttctgtgtcgtgtcattttgtagacggcatcattttcacgctttccaacaccaatgacagttaccgtgataatttcatcttcgacgctgtacaccagcctgtatcctgcaccacgcagcttaattttgtactgatcctttcttccatgtaattgagaagccggaacccgagggttttcaagccgttcccttagcttttttttaaactgttcctgtatggtatgacccagttttttccactcttttagtgctgattcgttaaatgccagcttataagtcatcaatgttgacctcaatgacgcgttcattcgcacgctcatcgataatacgaccgagttcttcatcctcaagaatatccataagatgagcataaagtgccggaggcacacagtagaaagccggttcattgcggttaagaatggcaactggagcgccatctccggcattgaaagttcccattggatcacgtttcagttctgtaatgcttgctgcagtagtcgttaaaatttgaaatgccataatttacctcctggttgatgactaaatatagcacctttaatagtactaataaaagcatccttcacgaaggggattcagctccagcccggtcagtgatgcgggcagctgacggttttttcaaggctaatttcagatgtccagaacctaacttatgaccactgaaaccggcgtcaataactcgccaacccttatcaagcgtgatgtaacaaccgaagtcagccttgcagatggtgatattattttacttggtggccttgctgaacagtcggatggattattctggcctctgacgtgtcgcagattgcagatcgtacagtcagggattacaaccgtattgccagaggaagcgataaaatatggtaagtgatactcttgaacagcggatttatgaactggtaagaagccatgatggaatttacctttttaagaaaaaagaactgacaccgtcaacagatttggattcagatctacagctggaagatgatgaagtactggcattgatggatgatttttttacgacattcaatgtagataaagggaatttctcgatcacaacatactatccgccagaaccaccgctaaaacatttgcttaatccgtttcgcaaaaacgatattcctcaggtgccggatttcacgataggtatgctcattgcgtctgccagggctggttgctggttgtatgactgattcacgctgggggctgctttccgccctccgtcattattgtcaaggctatatgccctaacaagttataggctctataaagatatatattgaacgctaaaataatggactattaggtgacaccatgcccacttataaacaagttgtgaaccatgttaagaaacatgtattgtggaaagatgagtattttgaacgctattatcggctcaatcctgaactggttcagaagcgtttggataaaatttatcaagctgaagatgatctaatggtgcttatcagtactcaattattttgtttcttgcaggctaatggcacgctctattttgatggttgctataaaacagggaaagcagataactcattgctttgtactaatcttgctctatggagtatcgagctagcttgtgatcattttgatattcgggaagagcggggacataccacgaagtttagcgagcagggagagagttggttaacactattcgcctgcaatcaattctctttagttccttattgctatccggccattcagcgcgggtttcaaagcggcgtattgaaagaaattgttccgttttatcgtgaacagaaattgggtatcctggcgatggagataatggcgcgtgaacggggggatacaatcaactgggaagcaatgcaagtgcgtgttgatcctgtctatctggacttttgccaaaacattttattgtcatcagatgatgaactagtccgcaccggattaattacgctatgtgataagcatcttgagtggaccgattttcataatagcgataagcattgttgcttgactggctatgaaattcagcgtcaggatctattactctggccatttgaatatcaggcggtaaaaaactggcgagcacgtcaagggttaagtacaccaatgattgaacatccattgatgaatagcccgatgacgacagcgaattgtcctgacttttcgcagtggcagcgtccagagtggttcaatccgttagttgattttttggcgcagcgcaggcctgagctggcatttttacgacatctctttatttaagtgagcgattattgtccagttttctctgggcctggcgcgcaactccaagcacatgacccagtcttttattatcaacaattgcgacggggtccacctccgacaaccggtcgaaggtggaataggggagcagaacgccattcagccgcagttccttatgcccgtcaggataatgccagacttcgatatatttaccgatggcccggcgactgtgctcgctgtcctcaatctgtggattcagatttcacaaacagcaggtgcatcaggcgactggtggcatagtcaacatagaccaaagcagtacagggtcgaccccagctttcaaaccagtggtggtcgcagccatcaatttgtatcagctcgccagtacaaggccgcctgtaacgaggctgatgaattttcggcgcgcgttatctgcgagggatccagattccggcttttatcatgaggcgtcggatagtttccttgccaagaaccagaccgtgaacttcctccagattttccagcgccagcgtggggccaaaatcacggtagtgctcccggattatacagagtgcctgatctatcagtgaagttggcaacagatggttaccaacgcggccacgactatggttgttcatgccaagtggtccgagttggcgataacgtttcagcagccgtctgcaatggcgtggcgtaatgccgagcatctcagcagcctgaccgggatgtaaattgcggtcgatggcatcctgaaggattttgaggcggttgattcctttcacggtgaacatcccggcgtcatgtctgagaactatagtctggacaatatgagccacaaatagacattagcattgagcctctacaagattggtgcgcataatgtatattatgttaaattcaccagaacatttaaaagacatgttaaagcggctggattcgtgtatgtcaaaaaacttctggcccataagtttgatcccttccctgccgtgacgctgcgcgaattctgttgatttgcacccgcttatcctgcacacgatttcacgcagcacacgccacgcaggcataaaaaaaccggccactgtgaccggttcgtcgcgcaggtttttggctcagtgggttttaccctggtccgctgctttttctgactgatgttctgcagctctgacaacggctataaacgctttgatacccggatccacatccggcgacaacatgcgcattgttgatttggcattcctgccgaacctcgtcaaaaatcgcaggataaccgaacgtgactttaatcagcgtgcgcagcatccctttggccacttccatttcacccgccataattcgccggcgtccaggtcgttatgatactgacaatacactggaaaatctgacggtcaaagcagcaaccggggaaaaacagtggccagttagcacagcgtttgcatgaactggtggatagttcggggaatcagcggaagaccccctattctcaaccatctcctcataggctttcctgaacaatgtgattgtttgagtaactttacgacaattgcttcaaaaactatcaaatgccagacttccgctaccagacggtatacacagtattactatttctttttatatgccccatacaaaagcgatacgggtgttttttctaatatctggatttcatttttatgtgctttatgttcactaaaaatatctgccagacttttacctccaaaggccaggccaattcccgttgctgctgctgaaagtaatgtcaattgcggcatggcaagtgaagctatacctaacgtggctgttcctgcaaaaattaatccagatgagatcttttttttctttgaattcttaatggctgattcatgcgactttccatactcttcgaccacattgattaaatgttttgaaaaattatttgccgcatcttgcatttgatctggtgtttttccttgcaagtcatgccttgagattcttagttcatgccttaaggattccagttgacctctttctctaatcttttttaattccagatcggaaagcgcagtaaggaattttacttccgcggctgaaaggcccattgtaatcgcttgctcttcagaagaaagaggatttaatttaccataatccttgaccaactgctccgtagtccattcatgtaaaaacatatggttactataaataaccggatcaatgcctaatagtgttgccgataattgagttgatcgttgtgcataaattgcaccttcaaccttacccagtaaggttgctatagctgacggcagatcgtaatccagaagatctacctctcttgttgtaaaactctttaaatctgtatcgtaaacccagacttctttttcgatgttattgaaattattaagcaatgtttttaataattctttatttgttaggatcttctggaatgtttcttcgtttctcccaaagtgctcaagaaacgctaaataagtagcgtaatccatttttctatctttaaaaaagagctggcttagaaaagcggcagattgttcatgattgcgttctttatcaaaatccagtaattcaggaacgattagaaaaattggataatcatcatcaatagtcataaacgggatggcgcgaaatagattagaaacatgttcaagtaataccaacctgcgcatgcggacataactattatctggtggcaatgacaaaaatgaatgcagagagctaagagaaggaaaatgtaatggatcaaccattatgatgctatcaaaataaatccccagagatctaaggtgattagatatgttataaccaaagcgttgaatcggaagtaataatcgataacttttagacgcccgcacttctgttataagcgccgcggcgtgagtatcccaaaatttatttagcaacacgattaggtttgtaagttgattatctaactcgggagagctaattagctctttcaggatgaatctacgtaattcttttagttctaaatttctgaatgcatatttatatttttcagaaaaagcgttttccatcaataaaacatattcattctgtatgctttttgtaatactactcatcatctatctccggaaccaccacgcaacgatttcccagtgtagtggttcttatcatgtgtatattgttagtcatgttatcgtagaaaattcagtggtcaataactcattgaggtagctactaaaatttgcagttaccaggatttaggatgattttaaaaatgtttataaattcaggctgcgccgcagtgattgcactgatttccacgtaacatgataatcaatggctttgataccctttaaacgaacaaatatgagcttaacatggcgacaataaaggatgttgcatccatggccggtgtatcaaccgcgactgtatcacgcgtcattaaccagaccgcgtgggttgaacccgtcacgcgcgaacgtgtagagaaagccatgcgcgatctcaattatcgccggaatgccgccgctatcgcgctggcgaaacgcagcggcgatatgctcggattgttaaccggcaatctggctgatcctttttttgcccgccttgctcgcggcgtagaagatgtttctcgtaagcagcagtatcgcttgatggtatgtagcggcggccacgacgaagaaatggaaaaagcgggactggattttctggttaatcaaggttgtgaggctattgttgtacacgccagccgattaccggataaagagctgctgcgctacgcagcccactttccagcgctggttgttgtgaatcgttatatagccggtatggccaaccggtgtatctggctggaaaatcgcagcgccgccagggaagcgacccgatatctcctggcgaacgggcatcggcgcattgcctgtgtgacatctgacttgccaattattgatcgtcaggaacgccttgatggttaccgtgaggcgctggaagaatatggtatttctccagaccctcgctgggtgattagcgttccgtttaacgaagaaggcggcgagcgggccgcgcatcaacttattaatagcgggcttccccttacggcagcggtcacgtttaacgatgtgatggccgctggcattatgcgtattcttcatcaacgcggcgttcagcttccgcaacagctctctattgtcggctttgatgatgtggtgctggcccggtatctttatccggcgttaacaacaatgcattatccggtcgaacaaatggcgcgttgtgccgcgcaactggcgatacagttataccagggcattacgccgccgcccagcagcaatcatttcaatgccgaactggtgatccgcgattctgtcgcgccctatttttcacggtgaatgcgtcgtcaacagtaaaaactgtgatggctatcaaattaacccttctcatgtaatcggttacatggacgaaagtaatggatcacagtagtgggaagcgtatccccctacccttgagctaccttactgaccggagctccattatgagtgcatcacaaaacaagaagaaaacgctgtcattgggtttagcgctaatcccagtcatctccatgttgttattgttgattatcggttacggcattatggggctacgtatcgaaccgctccttctgtgctctgcggcggtagcggcaggcattgcatggtggcaaggatactgttgggaagacatcatcaactcagtggtggataagctggctaaagcaatgccggttatcatgatcctgatctgcgtgggcggtttgattggctcctggatgtttagtggcaccattccctacatggtgtactgggggctaaaactcataagcccggaatatattttgattgcagccttctttttaaccagcgtggtctccgtctgtaccggtacatcgtggggatccgccgggacggttggcgttgcgttaatgggggttgccgccgggctggacgtgtctcttgcagcagcagctggcgccgttgtttctggcgcttatttcggcgacaaaatctcaccgttgtccgactcgactaactttgccgcgattgtcgcagacactactctgtttgagcatattcagcatttactttggacgaccctgccaagtttcctgcttgccgccgtggtttatcttatcgccggacacagtaatatgctgggcgaggtggctacgccgcagcgcgttacggacatcatccactcgctggagtcgctataccattttaatattgttcttattttgccgccggtgatcgtactgtggggcgcaattcgcaaaaagcctgtcatcccattaatgttaagcgcctgcgtacttgccttgttcctcggcgtcatcatgcagggactgagcatcaaacagggactggacgctttcattgatggatttgatatcgccatgttcccacaaggcgcagaaggtgtcgtggccgatgttccgcgcctgctaaaccggggcggaatgttctcgatgatgggaacaatactgttagttttctgcgctttttcatttgccggagcgctaacgttaaccggcgcgttaacaatcatcattaaccgactgctgaccattattcatagcgttggtcaactcattgccgccactatcggcaccacaattttggtcacaggagcgaccagcgacggtaaactggcattgttagttcccgccgaactgtttaaagatgcctatcgtcgtatggggctggatactaaaaacctttcacggacgatagaagatgccggtaccgttatcgaacctctcctgccgtggacctcggctggcgtctacatggcaaccacgctgggcgttagcacgcttgatcttctgccctgggctatccaatgctatgcggcaatcttcttcgcattaatttatggttttagcggaattggtattgccagaactgcctccgcctcagaaaagtcgccgcaatcgtcagtgacggaataataaggaaacaagatggattttaaccagattatcaatcgcaacaatactggttcggtaaagtgggattttattgagcgtcactttggcgatggcgcagggaaactgctgccgatgtgggtttctgatttcgattttgcctgcccgcctgaggttcaggcggcattgcatcagcgaatcgagcacggcgtatttggctatagcgaacgcgatgaggcctattttaacgccctgcttcactggttttcatcacgccaccagctcacgttaaaacaagaatgggtatgcagcgtggaaggcgtcgtaccagggttggcgctcttagtgcaaatgttgacgcatccaggcgacggcgtagtggtacaggggccatactatggctccttcgccaaaataatcacgcttaatggtagaaaactgctggagaatccccttagcgagtcgccggacgatggctaccagatggatttttgccaactggaaaggctgtttcgccatgagcgccctccgctgatgattttgtgtaatccacataatccaaccgggcgttgctggtcggccaacgagctggagcaactgcttttattatgtgaagcttatgatgtcactctcatctcggatgaaatatgggccgatctattgctgcccggcgaaacctttacctcggtactgcatttaggggtgcgctggcataaacgggtcatctccgccactgcggccagcaaaacgtttggcttatcgtcgttgcgaatttctaattttctcattcccgatcctacgcttcgccagcgtttcctgtctcgtctggacgctcatgggctggatgtctttaacgccctctccgttcaggcggcgactaccgcatggaatgaaagcagacagtggctggattcgctactggattacctggcggaaaaccgccgctggtttgttgaacatgcgacagagcaccttccctgggcaagaattgtcccggcgcagggaacctatttattatggatggattgtaaaaaactgggactggatgacgaacagctaaaatgggtaatggcggatgtcgcgggtattgctccttcaatgggcagcggctttggcccggcgggcagcggatttatccgtttaaatctgggatgtccacgtacctaccttgaaatggcaatagacggcctgaagcgaatatcggtgaagacaatcaaaggaataccaacaggcggatgaatttttcgggcggtaaactgacaacggtgttatttctgcggcatgatatcgcctgagcgccagtaaaaaaccggccatcaaggccggttgggtccggagcgcggttttactatcaggggcgtctgaataacacgatactgcgcccggccagatcgaaatccatttcttcggtaatccgcattccctgctgcgcgttatcggcagtcgtcagttcaagtacccagccgccttctccccacatcggaatacggaacggtacgctgccttcaaacggattgaaaagcagtaaggcgtcatgccagatccccgcttccggctgaagatcgggacgactaatacatacgcctatggtcgatccctcatcccattgttcggattgctgcgcccctccgccggcgttaaaccagcggatctccagaccgtcacgccagctctcccggcgcagcaacggttgcgtggcgcgcagttgaatcagatgacgggtaaactcccgtagcgcattggcggtttccggcaaattatcccagtggacccacgatatttcactgtcctgacagtagccattgttattgcccatctgactgcggccaaactcatcgcccgctaataacatcggcgtgccgtgcgagaaaagcaaggtggtcaggaaattacgtttctgtcgctcgcgtatcgcattgatgccctcgtcgtcggttggcccttctgcgccatagttacaggagcggttatcattatgcccgtcattattatcttcgccattggcttcattatgtttgtcgttataagacaccagatcgttcagcgtgaagccgtcatgggcagtaataaagttaacgcttgaccaggggcgacggccgcgcaaatcatagagatcgccggaacccagcaggcgtgcggcgaaatcatttgtgacgttgtcacctttccagtattcgcgtaccgtatcgcggtatttatcattccattcgccccaccctggtggaaagccgccaacctgatagccgcccggtccgatatcccagggttcgccaatcagtttcagttttgccagcaccgggtcttgcgttaccgcatcaaaaaaaccgcctctctgatcaaagccttccggctcacgaccaagaatggtgcccaaatcaaaacgaaagccgtcgacatgcattgactccgcccaatagcgaagggaatccatcaccatttgcagtacccgtggatgagaggtattgacggtattacctgtccctgtatcgttaatgtaatagcgatgctgatcgggcatcgtgcgatagtaagagaagttatcgatacctttaaatgacagcgtggggccaagttcattcccttctgccgtatggttatagaccacatccagtatcacttcgatgccggcatcatggaaagcgcgcaccatatcgcggaatccctgaataccttttggaccatagtagcgcgtcgccggcgcaaaaaagcccagcgagttgtatccccagaaatttttcagtcctttatcgagcagatgctgatcgtccgggaaccagtgaacgggtaaaagctcgacggaggtaatccccagacttttaatgtaatccacgctggctttatgccccatgccttcaaacgtaccgcgtagaggctcagggatcgcggaattaagctgggtaaagccttttacatgcgtttcataaataatggcgttcgaccacggtatggaaggccgttgtctatcctcccagttagcctcatccggatcaatcacccggcatttaggcgtaaatggcgcgctatcctggtcatcaaaggtcaaatctttatcgtcatgaagtaattgatacgcgaaatgcgcatcgttccactgaatatcgcccaccagctcacgggcataagggtcaataagcagcttgttggggttaaaacgatgaccattttccgggtcataaggaccgtaaacgcggtacccatacagcgcgccgggctgcaacttcgggacatagccgtgccatatttcgtcagtatattccggtaactccagacgagcgatttcatgctccccgctcggatcgtaaaggcaaagctcgacgcgttccgcatgggcggaaaaaatagcgaaattcacgccttcgccgtcataatttgcgccaagcgtatggctgtatcctgatctgatttcaaaagccctgtttgttgtcattctctttctccacccacggtaaacgttgtcctgtcacggcacatcaacacataaactcagtcgctcattaaaaccagtacgccgccctggtgtgaggccaacgacaggcgttcaccaggcattaacctctcctgggtaagcacattgcgataacgatgctgattaagctgtccgggtataataatgtcggttcctgaccagaaaccgctatgcgattgtgacaataagccgtcacattcggcgaacaccagtcggggcgcaacaacaatcagcgcatcatcatgattgactctggcgtaagcgatgaccttgtcggcacgctgaccaacagcccgcagcggtatatagtcgccaaaacggaagagctcatgattctgctgacgcagacgcagtaatgcggcggtgacatactgattcacctgcccgttcagccaactctcttcgcgcgagaaaactcccggcgtcagttggtctaactgctgcgccagcgtggcgaaatccggttcgcggcggttgtcgggatcgacaagactaaaattcaacgcctcgcttccctgatagatatcaggtactcccggcgcggttaatttgataacggtctgcgtcaggctgttaaccagtcctgcgcggatgaagggttgcaaggaacgataaaaatcctgcaaaaatgtctgattatccggcgccagtaaataacgggcgtaatcaagcattgccgtttcgtaagcctcattactgtccacccaatcggtacgcagcttcgcttcgcgtagcgctttctccacaaaggcttcaaagcgtgttttcagcgcgtttaggcctgtttcatcctgtggttgtagcaccgggggccagacgccggtcagcgcctgatataacatccacgtatccgccgattttggcgcagtgccatcattcaaaaatttgacatgggtctggttcatctgccgccagcgggcaaggcattcgctccactgctccggcgcttcggtaagcgtatacaggcgtgctcgcgcatcctcgcctcgcttggtatcgtgggtcgacgtaccggataacgcatcaggctgtcgcgcctgtcgggttttcatctcatggtgaaagcgttcgatggagaagtgatgcgtgacgggctcggcgccgacttcatttaacgccagtcccatgttttgacgaaagaaaagcgtatcctctaccgatttcgccatcagcggaccggtgagttgctggaaccgaacgcgaaactgtgtcgcctcctcctggctggaggcgggaacatcgccggtaagaagacggctcagaaatgtaagcgcttctggctgcggaggggtttcaagcgtctttacccgttccacaatacggtgtaacaggcaaatatcggtcggtggtagcccttctgccgtgccgtaagtgcgatatacgggaaaggcaattaataactcgcgtaacgcctgccgaacgacgctctcttcctgtgcgatctgtagctcgctggcaatcgacagcgcaagcgcgagcagccgggtaaattccccctcgaaattgcgatcgaccatcagcaatttagccgcccgtaattccgcccgcatatccactggcgcgccttttacggtctcgtaagcctggcgcagattgtctatctgctcatcgtcaaccagcacctccgccagcgaggcgataaattcatagcctgtggtgccggaaaccggccagtcatcaggaagttgctcgcctttagcgagaattttttccacggtgatatagcacgccggccccacttcctgacgtaaacgcgcaagataggctttcggatcggcaaggccgtcgatatgatcgatacgtaaaccgtcaaccgcccccgttctgaccagctccagaatcagccgatgtgtatcgtcgaagacggttttatcttccacccgcattcctaccagccctgtgacctcaaagaaacgccgatatgaaagcgagcgagcggcatcgcgccaggacattaatttccacggctggcgctcatgcaaatcagcaatagcggctttatcggtaagcgccagtatttcagcctcgcgcccctgccacgtcgccggcgcaagcggataatagttatcataataggcgaacgcgggtttacccgtagcgggatcgggcttgatcgcaatttctccgttttccagcacggcgtcaaacgtgtcgcctaaaaaaggcagcgtcagtcggcgcgaccagtcaatatcgaaatggcgcgcgtaacggctctccttgccatattcaagcacgtcgcgccaccaggcgttttccagcgagctggccatgtgattaggcacaatatcgatgatcaatcccagaccttgcgctttaagttcagccaccagtctttcaaatccttcgcgcccgccaatagaaggctcaatctcattcgcatcggtgacatcataaccatgcgttgacgctttggtggcggtaaagatgggtgaggcataaagatggctgatacccagatttttaaggtaaggcaccagcgccgcagcgcgatcgaaggtcatgccattgcgaaactgaaggcgatacgttgcagttgggatcatgatgcagactctccctgggctaagcggacaataagagaatgttgggaaagcgacccggtggattcattcggccaggcgaagagagtcttacccggtaaatcgggcagcaataccgtcgtggcgctaatattcagcgccagtgacagcgttcctcccggaaaacgccagctaacggcaataaacccgggcgcggtttgcaataccgttcctgagctctcacgggcagcggacaacagcggcacgatatgcttctggcgcaaaagcagtagttcgcgggtaaacgccagccacgctttaccctcttcactgtgctgttgcttccagttaagttttgagcgttgaaaggtctctggcgcattcgggtccggaacattttcccctgcatgatcggcaaactcttttgcgcgaccttcacgaacggcgcgggctaaatccccatggaaatcggtaaaaaaaagaaaaggacggctttcgccatactcttcgcccataaaaagcagcggaatatgcggtgaaagcagcaacgtggcgagcaatacttttgttcgttcagcacccgccagggttatcagtctgtcgccctgggcgcggttaccgacctgatcgtgattctgaataaaatccacaaaagcgaccgggggttgtccggtactttttacgccgcgaggttcgccggtttgcggtgaaatttctccctgataagcgaatccttcggccagcgctcttgcgaggtgtttttccggggcatcagcaaaatcgttgtagtaggcctgggtctctccggtcgcaaaaacgtggacggcattatgaaaatcgtcattccattcggcggtaaacagcggcgcattgccatcctgatctcggggatgcagagaaataatattgcggctatcttcggtggtcagatgaatgggcctgtcggtaatgtcttcccgaatacgttgtgcgatttcaaccagcacatgcctggcgctactgtcctcaatctgatcgatagcgtcaaagcgtaagccgtcgagatggtattctgtcagccagtataacggcgcctcgatgatatagcgccgcacggcgtcgacatcataggcgataccatttccccacggcgtcatgcgctctttgtggaaaaacgccggcgccaatagcggtaaataatttccttccgggccgaaatggttcagcacaatatccaggacgacggaaagaccatacccatgcgcggcgtcaataaacgccttgaaatcatccggcgtcccataggcagaatgcggcgcgtaaagcagtacgccgtcatagccccagccacgctcgccgccaaattgcgcaacgggcatcacttcaataacggtaacgccgagttcagcgagataaggcagcttcgctattgcggcgcggaaggtgccttccggagtgaacgtgcctgtatgcatctcatacaccacggcctgctcccaacggctacctttccacccggtgttgcgccacgtgtagctgcctggatcaaccacatatgacggaccgttgacgtcagttttttgggcgcgggaagccggatcggggaccaccatgccatcgctgagtacaaagttatactccgtacctggcgtcaccccggcgacgtccagcgtaaaccagccgtcaccgttcgcctgcatttcctgatctttacccgcaagcctgagcataaccttttgctgaccggtggcccaaagacgaaagcggacaacatcagcggcgatatattcagccccccagcttttgcaaaaaatttttgaactcatttgtcgctccgtttaacccataacctctacaacatccgaagaacaagcatagactatggggctaatctttacgtgacgctgtcacttaacaggcattctttttcgtatctgcgtgtaaaaccgtggaattattgtcgggattgctcagatgtaccgaagtgcgcggtatcgcctcgcccgtgttcgccagagccctgaacacgctgtagctggataacctctccctgctcccaggcgttagcccccttaacaacgggatgttcaggcagatcctgccgctcgcgtttaatggcttgggtatcaattcccagacggcgatcccgatcggccagcagcgcggggtcaagctgcccgtcgccagtaaagcccatcatcagcgcagggatacccattggcagggttttatcccggtcggtatgccaggtgtgccaggtcttgccataagtattaacaatcttactcatcaacgctttatcagcgacctgcggtaagccaggcgccaccaggctaccggatttcacctcgtactggtggctgtgccacagttttttctcctcgggaggaagcgttttaaataaacgttcgctgataatgtactccacccccatcaggcgcgcgtttttcgtattgccgtcgtaaatcaccgcctgcatgacatcttcgttcaggacggtaacgtaatggtgcgcttccatctgtccgtttttatcaccgctataaaaatggaacccgtcaaggtaggtactgatggcatcgacaggtggtctggattgaatagccgccgcgcctgtttccagggtacgtaatttggcagaggttttttccccgggaataggtgtttgcggcggcgtattattggcgccgcatccggccagaaaaggaatgataaagagtgccagcggtaaaattttcattaggtctccatatagtgaaagggctctaatgaaaatagtgcaataccacgtgattggtagaagaaatggaagatgttatttgtgacggtgtcacaaatagtaaaacccgacacacaggccgggttttgatatcagtttactcttattttgagagttctttcttgatttcgtcttttattttgcttaattcactctgcgggtttttcttacaaagctcaacggctagcggcactgctgtcgtctcagtttcctggaaatctacgtagtccccgcctttaaaatcttcatcttcattcagcacccagaaagcgactggcgccatcgtctgcggattgaggtcaacaaactcctggcagctcatacctttaggcgtaacgtttgttttagtagtatctgttgccgcattcacgctaacactggttaccagcgctgccacgataatacctgctgtagcaagggagaatttattcattgttgttgctccaataattatataaataacctctacatctgcgcgttaacccgttaatgtagaacacagaaaataatacccctcctctctcaggaataaagatcaccctccgtgatatggctattattgatatttacgttgactgattttgatgtttgatgaataaagcaacatggcgagcagattttaaggcgaaaaagtaggccacgacaatagccgcagacgtggtctacggcgcgttgaggtgatagaaatacggcaggatctcagatagaccgggagcgagccctccgtctgaaagtatattcatcagcccgatcaacccatcgttaccgggctggagaggttatcaggcgttaagctggtagtcgagggtgatttccgcattcagaacctgcgataccgggcacccggcttttgctttctggatgatttgatcgaaagttgaagcatcaatatctgctaccgcgactttgctttgtagcgcaattttggtaatggcgaagcccgcctccaccttatcaagcgatacgtcagcggtggtgtcaatggatgtcggcgtaaatccagcctctcccagcatgagtgatagcgccatggagaaacaggccgcatgtgcggcgccaattaactcttccgggttggttccctgcgcgccttcgaaccgggtattgaatccatacggttgttgattaagcacgccgctttctgttgatacagtacctttaccccgtttgatgtcgccttcccagtgtgcctgacctttcttatggattgtcatttttgctctcctgttggctcaaaaaataaagtatagaccatgctgctaatctgcgttgtccatgccgatggaggtagcatgttgtcgattacccgcacttcagatatagaaaatagttgtatgttttttcagtgatgaatattaaaccaacagggctccctttctttaaagaatatatccctccttttgtccttactttttcttctggaggcgtattccattatgtatattttatatgtatattgagatttatcctatcccattgtaataaaggataaaaatcacaataagtagccttttaaatgtatattaattgaccactatttgtatgaggatatgtaattggcaaacgtaatatattttcttcaggggtaaacaattagagttccgccttgcgttaaaataactccaggactaatcttaaccacagccgcaaaaatatttgccatgctgaatacgaattaattttctgcgagccgtactaaataaatacatgttcacggaggcattatatgtttacttatcactcagcaaatacctcagcagcacaaccggccctggtcaacgcgattgaacaaggattacgcgcggagttaggcgttgtcactgaagatgatattttaatggagctgaccaaatgggttgaggcttccgacaatgacatcctcagtgacatctaccagcagaccatcaactatgtggtaagcgggcagcacccgactctgtaaaacctgctatgctgtatcggcaaccttaggggttacgtttctttcgcgtaagcgaatttgtccttaaaactagcaacaggattgaggagttaacatgaaatcgaaccgtcaggctcgtcatatacttggactggattacagaatttccaaccagcgtaaggttgttactgaaggcgacaccagcagcgtggtgaataacccaaccggcagaaagcgccgcgccgacagccaaaagtaatcgtacagtcctgaaatgacgttaaacaccattgcatctgcaatggtgtttttgtttataggaatgaccttaacgtctcacaatgctttatactcagggtcggttccctggtggaaggcaatatatgatgataaacgacggtgccagggacagttattcgaaaaagagtgagtaacatggaaactacaaccaagaaagcacgttccctttatatcccttacgctggccctgtattgctggaattccccctgttaaacaaaggcagcgcttttagcgtagaagagcgccgcaacttcaatttgtcagggctgctgccagaggtcgtcgagtcgattgaagaacaggccgaacgcgcctggctccagtatcaggggtttaaaacagaaatcgataagcatatttacctgcgtaacatccaggataccaacgaaacgctcttttatcgactggtgcaaaaccatcttgaagagatgatgccggttatctataccccgaccgtgggcgcggcctgtgagcgcttctctgagatttatcgccgggcgcgcggcgtatttatctcttatccgaaccgtcacaatatggacgacattttgcagaatgtgcctaaccacaacattaaagttattgtggtgacggatggcgagcggattctggggcttggcgatcagggcatcggcggaatggggatacctatcggtaagctgtcattatacaccgcctgcggcggcattagtccggcctatacccttcccgttgtgctggatgtcggcaccaacaatcaacagttactcaacgatccgctttacatgggctggcgtcatccgcgcattaccgacgatgagtattatgcgtttgtcgatgagtttattcaggccgttaagcagcgctggccagatatcctgctacagttcgaagatttcgcgcagaaaaacgcaatgccgctgttgacgcgctatcgtgatgagatttgctcctttaacgatgatattcagggcaccgcagccgtgaccgtcggtacgttgatcgccgccagccgcgctgccggcagtcagcttagcgagcagaaaatcgttttcctcggcgcgggttccgccggatgtgggattgctgaacagatcatcgcgcagactcagcgtgaaggtttaagcgaagatgccgctcgacagaacgtttttatggttgatcgcttcggcctgttgacggaccggatgcctaatttattgccgttccaggcaaaactggtgcagaaatgcgacaatctccagcactgggataccgaaaatgacgtgttgtcgctgctggatgtggtgcgtaacgtgaagccggatattctgatcggggtttccggccagaccgggctctttactgaagagatcatccgcgagatgcataagcattgccctcgcccgatcgtcatgccgctctctaatcccacctctcgcgtggaggccacgccacaggacattatcgcctggacggaaggcaacgcgctggtggcaaccggcagcccattctcgccggtcatctggaaagataaggtttatccgatcgcacaatgtaataacgcctatattttccccggcatcggacttggggttatcgcttccggcgcatcgcgcattactgatgaaatgctgatgtcagccagtgagacgctggcgaaacattctccgctggtgaataacggcgaaggattagtgttgccagcgcttaaagacatccaggtcgtgtcgcgcgctatcgcttttgccgtaggtaaaatggcgcagcaacaaggcgtagcggtgaaaacctctgcggaagcgctgcaacaggcgattgacgataacttctggaaaccggaataccgcgactaccgtcggacttccatttaatacgtacccggcggtgaatgccgccggatatcactttcttctttagttttggtgagtctgtcgacacacctgaattcctttccctgcttatttgtcaagctactaatattagccacctttatgtattgaacggggatttatcaggataatcctggctaaactattacattgtatttctgccgccttgcataactcatcagaaatattaatcctaaagaggtaatagcgccttacctgctattacttacctgctatgcagttcactattaataaaaggagaaggttatgaaagctgctgttgtcacacaagatcatcaggttgatgttactgagaaaacgctgcgtccccttcgccacggtgaagctttgctaaaaatggagtgctgcggcgtatgccataccgatctacacgtgaaaaacggcgatttcggtgacaaaaccggcgttattctgggacacgaaggcattggcgtcgtggcggaagtcggtcctggtgtcacctcgctgaaacccggcgatcgcgcgagtgtcgcgtggttttatgaaggatgcggacactgtgagtattgcaatacgggcaatgaaaccttatgccgcaacgtgaaaaatgccggttacacggtagatggcggtatggccgaagagtgtattgtcgtcgcggattatgcggtgaaagtaccggaaggtctggactctgcagcggcaagtagtattacctgcgcgggcgttaccacctataaagcggtgaagatttctcatattaaacctggccagtggattgccatctacggtctgggcggtctgggtaatctggccttgcagtacgcgaaaaacgttttcaatgcgaaagtgatcgccattgatgtcaatgatggacaactgaaactggccgaggaaatgggcgcagatctgaccattaattcacgtacggaagatgcggctaaaattgtgcaggaaaaaaccggtggcgcgcacgcagcggtggttaccgcggtcgctaaggcggcgtttaattccgcagtagatgccgttcgcgccggaggccgcgtggtggcagtcgggttgccgccagaagccatgaaccttgatatccctcgcctggtgctggatggcattcaggttgtcggttcgttggtggggacacgccaggatctgaccgaagccttccagtttgcggcggaaggaaaagtcgtgccaaaagtcgctttacgtccgcttgaagatatcaacgttatttttaaagagatggaacagggacaaattcgtggccgtatggtcatcgatttccgtcgttaaacgatttgctgtggtcgtctgagtatacagacagcagatgaaaacaaggcgctaccaggatagcgccttgtttatcagattgcgaaagaattactgaataccttcttcgctctctttttttgcttccgccttctcgatttcacgataccagcgtggatgatgtttcttcgcccagcgacggctgaccttcccttcgatcatgcctttaatcgagcctttcacccaaaatgccatatacatatggatgaggatcgcgtgcattaaaataatgcccgccgccgcatgaatcaacaggctataacgcaccacctgcatggggaaatactgcgcgaaatacggacgccagataatcacgccagtcaccagcagcacaaaaatcatgctcataatggaccagaacatcatcttctgtccggcattgtatttaccgacatccgccaccttatgctcattgcctttcaatacttcgacaatatttttcagccacggaatatcttttttatccgggatgttgtggtggacgaaacgcacgaacataaacatcagcgcgatgaagatggcaataccgaagaacgggtgcaaaatacgtcccatctgcggcgtgccgaaagtttgcgtcaaccattgtagcgtcgggaagaaaaacgaaatccccgacagcgctaccaggaagaagcagatcaccaccgtccagtgacaggcgcggtcgacaaatttcgtgcgcacaatcattttcgacttactcatgatgatcctcctcatcgtcgtccgtttctttattcgggccaataccgatgtagtggtaaatcagaccggcgaaagtggcgataaagcccgctgcggccagcggttttagcgcccctttccacagattgattgaggtatcgatctgcggatctttcggcaagccgtggtacaactccggctgattggcatggtgcagcacatacatgacgtgcgtaccgccgacgccctgcgggttgtagataccggcatgttcaaagccgcgcgcttttaacttctccacgcgttgctcacccagttccagcatctcttttttggtgccgaagtgaatagccccggtcggacaagttttgacgcaggccggttcctggcccacgctgacgcgatcgacgcagagcgtacatttataaacgcggttgtcctctttgttgaggcgcggaatattaaacggacacccggcgatacagtaaccacagccgatacagtgttcagattgaaaatcaacaatcccgttcgcgtactggatgatagccccggcagatggacaggctttaagacagcctggatcttcacagtgcatacaaccatctttacgaatcagccactccagcttgccgttctgctcggtttcggtaaagcgcatcaccgtccaggacttggcgctgagatcggcagggttatcgtacaccccgacacaatgaccaacgttatcgcgaatatcgttccattcagaacaggctacctggcaggctttacagccgacacaggaggagacgtcgatcagtttcgcgacttcggctttgtaatcacgcgcctgcggaggcggcgtgatggcgtttgttgcggaccgtttaataatgtcctgcgtttccatagacatatgttcgcctcccttacgccttctcgatgttaactaaaaacgctttgtattccggcgtttgcgagttggcatcaccgacatttggcgtcagagtattggcgatatagcctttgcgcgcgacaccctcaaagccccagtgaatcgggatccccaccgtttcaacctgctgaccgttgacatgcagggtgcgaagacgacgagttaccaccgcgaccgcgcgaataaacccgcgtttactgctcaccttcacatagtcgccgttagcgatacctttcgctgccgccagcgtctcactgatctccacaaactgttccggctgagcgatagcgttaagtagcgcatgtttggtccaggtatggaaatgctctgtgaggcggtaagtcgtgcccacgtacggaaactgctccttcttacccatgcgcagcgcatcttcttcatacagacgcgccgccgggttcgagaccacattcgggtgcagcgggttagtgcccagcggcgtttccatcggctcgtagtgttcagggaacggcccttccgccattttatcaatagcaaacagacgtcccagcccttccggctgcatgataaatggattggtcccgctccccggcgccgcgttgttaaagtccggaatatcgttccctgtccacttcgcgccgttccactggatcagcatccgttttggatcccacggtttaccctgcggatccgccgaagcgcggttatacaatacgcgacggtttagcggccatgcccacgcccaacccagagtattgccaagccctgacgggtcggcgttatcacgtctggacatctggttgccctgctccgtccagctaccggtataaatccagcaggaggaggatgtcgtaccgtcatcgcgcagtaatgcaaaactgctcaacaactggcctttcctggcaagcagtgtaccgttggcgtcatagagatcttccagcgcatagccgttgttctctttcgccacttcttccgaatgcggttcatccggctgcttgtagttccagctcatcttcaatagtggttcggcgcctttaccgccttctgcgcgatacatttcacgcagacgatggtaaataccggccagaatctcgccgtcgttacgcgcttcgcccggcgcgtcctgacctttccagtgccactgtaaccagcgaccggagttagcgatagagccatcctcttccgcaaaacaggtagacggcagacggaagacttcggtctgaatcgttgtcggatcgacatcattagattcgccgtggttctgccagaacgttgacgtttcagtcaccagcggatcgataacgaccagatacttcagtttgcttaagctttgcaccactttgtttttgtccgggaaggacgccaccgggttaaagccctgacagaaatagccggtgactttcccgctatccatcatgttgaaatatttgatcacgtcataggactgatcccacttaggcagccaggcaaagccccagtcattctcttgctgcgccgcatcgccatagaaagatttcatcaggctgacgaagaacttaggataattaccccagtagttgacctgatcggccagcgtcgctttgggggtattcgctgccagataagtttgcagatcggcctgtttttccgatggcagcgtcagataacccggcaggctggtggagagcagtcctaaatccgttaagccctgaatattagagtggccgcgcaaggcgttcacaccgccgccagccatccccatattgccgagcagcaactggatcatcgccatagtacggatgttctgcgccccgacggtatgttgcgtccagcccagcgcatacaggaaggtggtagtgcgatccggaacgctggtagaggccaacacctcacacaccttcaggaaatccgctttcggcgtaccgcagatgttttccacgacgtccggcgtgtagcgcgaaacgtgctgcttcagcagattccacacacagcgtgggtgcgtcaacgtttcatcacgtttggcatagccgttttcatcaaactggtagttccaggaggatttatcgtactgacgcttttgggcgtcatagccgctgaaaagaccgtcatcaaaggcaaaatcatcccgcaccagcaggctggcgttggtgtaatgcttaacgtattcagcgttgattttgttattttcgatcaggtacagcaaaacgccggacagaaaggtaatgtctgtaccggaacgtattggcgcatagatatccgccaccgacgccgtacgcgtaaagcgtggatcaacgacaatcagcgtcgcatcgttattgtttttcgcttccatcgcccagcggaaacccaccggatgcgcttctgcggcattgccgcccatcaccatcacgacgttggcgtttttaatatccacccagtggttggtcatcgcaccgcgaccaaatgttggagcaagacttgctaccgttggtccgtgtcaaacgcgcgcctggttatctaccgccagcataccgagagaacgcgcaaacttctgcgtcagcatacccgtttcattgctggccgccgaggcgcacagcattccggtagagagccagcggttaaccgtgacgccctgctcattcttttcaataaagttggcgtcgcggtcggctttcattaatttagcaatacgagtgaaagcgtcatcccagctaatgcgctgccacttgtcggaacccggcgcgcggtattccggatagcgtaggcgatcttcactgtgaacatagtccagcaaaccggcccctttcgggcacagcgcgccacggcttaccggatgatccgggtcgccttcaatatggtaaatcgcttctttcgcgttttttgccccatctcccaggctatacattaatagcccgcaacctacggaacagtatgtgcaggagttacggatctcttttgcgcgcaacagcttatagtttcgcgcctgagccagggccattttaggggtaaaacccagtgcggccaccgttgttcccgccataccgcccgcgcagattttaaaaaattgtctgcggctgacgtccattgctttcctcttttttccacggatgcacgcctccttcgaactgcagcaaaacctcagcccaggatgcgtgtataacttcgcgaggaaactaacagcaaaatcgataacttttttgcgtcaaatcaatattgaaacggttccgctattaaatagccctatttttaaactgcaataactccagggaggtactaaaaaatgacactgcatggcatcgccctcggaaaaagtgctataagtggcagtttattttgcgcggtattcaggacagtcacaaagcatgacatcacaaaaagcaacgctaatagggcttgttgccatcgttctgtggagcacgatggttgggttaattcgcggcgtcagcgaaggtctcggaccggtaggcggcgcagccatgatctattcattaagcggtctgctgctgatttttaccgtcggattacctgatatccgccgtttcccggggcgatacctcatcgcaggcagcgtactgtttgtcagttatgaaatatgcctggcgctttctctcggttatgccgccactcgccatcaggctatcgaagtcggcatggttaactatttatggcccagcctgaccattctgtttgccattctttttaatgggcaaaaaactaactggcttattgttcctggattgcttattgcacttactggcgtttgctgggttctggggggcgagaatggtcttaatcccggagaaattatcagcaatgtcgccaccagtccgctaagttatttactggcatttcttggggcgtttatatgggcgacgtactgcacggtcaccaataaatatgcgcgtggttttaacggtatcaccgtctttgtgttactcaccgccgtggcgctgtggttacactattttcttacgccgcaacctgccatgatatttagcctaccggtgattgctaaactttttaccgcggcattaacgctggggtttgcctacgcagcatggaatgtgggcatacttcatggcaatgtgactatcatggccgtagggtcttattttacccccgtcatgtcctctgctctggcagcgctgttactcagctcaccactgtcattctccttctggcaaggcgcagtcatggtttgcgtaggttcgctactttgttggctggcaacgcggcggcgctaatagcgacgggcgggccgatattgatattaaatcgacccgctgtaccttgacactcttcataacacaactacgcttttatctattgcctgtgcgtatttaacgattttccattttcacgtgctcctcctgcgccataccaggattgcgctggtaaaaatgaattttataaaatcgttaaatatgttaatgtaatgatgtaattatattaacaaatatataattaacgttagcttgcaactgttattagtgcatataataatcagtggttactaccaaaaataaaaccataaacagcccaatagtcccctccgaaaatatatcttattagacagtccctatttgaattaatactctcaaatgtattaaggagatctcgatcacacaaattaaaataatttgtaatcttatgaaacttattattgaacttatgccactccgtcatttaaaaatagtctgccattgacaaacgcctcgtttaacaatggttgaggaaacacgctaagaaaattataaggattattaaaatgaaacttaagttagtggcagtggcagtgacttccctgttggcagcaggcgttgtaaatgcagccgaggtatataacaaagacggcaataaactggatctgtacggtaaagttcacgctcagcattatttctctgatgataacggaagtgatggtgacaaaacttacgcgcgtctgggctttaaaggcgaaacgcagatcaacgatcagttaaccggttttggccagtgggaatatgaattcaaaggcaaccgtactgaaagccagggcgctgacaaagacaaaacccgtctggcgtttgctggtctgaaattcgctgactacggttctttcgactacggtcgtaactacggcgttgcttacgacatcggcgcatggaccgacgttctgccagagtttggtggcgatacctggactcagactgacgtcttcatgactggccgtactactggtgttgccacctaccgtaacactgacttctttggcctggttgaaggtctgaactttgccgcgcagtaccagggcaaaaacgaccgtgacggcgcgtacgagtctaacggcgacggtttcggtctgtccgcaacgtatgagtacgaaggttttggcgtaggtgcggcctatgcgaagtctgaccgtactaacaaccaggtgaaagcagcgagcaacctgaatgctgcgggtaaaaacgctgaagtctgggctgctggtctgaaatatgatgcgaacaacatctacctggcgaccacctactccgaaacgctgaacatgaccaccttcggtgaagatgcagcgggtgatgcgtttatcgcgaataaaacccagaacttcgaagcggttgctcagtatcagttcgacttcggtctgcgtccgtccatcgcttacctgaaatccaaaggtaaaaacctgggtacttacggcgaccaggatctggttgagtacatcgatgttggcgcaacctactacttcaacaaaaacatgtccaccttcgttgattacaaaatcaacctgctggacgacagcgacttcaccaaagcggctaaagtgtctaccgacaacatcgttgctgttggtctgaactaccagttctaattttgttgtagtctgaatacaaagccagtcctttcagggctggctttttctcttgatgtagactcggtcataaggagtatgccgtgcagacgttcactggtcgttgtctttgcggacagagccattttaccgttgacgtcgaaatgctggatgtctatgcctgccattgtacgctgtgtcaaaaatggtcgggtggaatagccatgtatctggaagcctgcgggcaaccacagctagcccccctttccccggaaccgccatacttttcatcctcttcgcgcggcgaacgctacttctgttccggctgcgggtgtccgctgtggtttcggcttaccgataccgatcgctattttattccctggaccttactggaactgaacgaagttgatcgccgtcggctgattctggctgcggaaatttataccgagacccaacctgccttctggcgactgacggggcaatacgcacgcctcagcggtaaagaggttgaggaaatggactccccctgccagctagcgcattaagcgcttatctcaccaggcgttatgttatcggcgttgggcttttgccaggctgaaccacatccctaccgccagcaaaagaagcatactcccggcgctgcttaacgccacgctatgcgaccagataaaggcatgtctggcggcgtccagtattgcctgcccctgcgtgggcggtaggctattcgccaactgcacggcttctcccattgaagatgacgctctggcaatctcttgcgcctcaagcccggcaggcagacggatagacgcggagaagctacggcttaacaacagaccgaaaatggcaatgcccagtcccgcgcccagttcataagccatcgtttctatcgcgccggccgccgccgctttttctgccggcgcagcggccataattgccgacgtggaagccagcaatgcgctggcggcgctaaatcccagcagcgccatcagcccccaggcctgccattgttgggtgctgaaatccgtcatcgccaggccataaaaactcagcgcgcttaacgccatgccgcccgtcgcgaccagccgtagtcccagacgcgagaccagcacgcccgcaatcggcccgctgaatccactggcgaccattaccggcagcataaataccccggcctcataaggcgatagcccgtgaacaaactgcagctcttgcgccatcagcagctcaaaacccaccagagtgatcatcgcggtcatcgccatcacgacgccgctcaggataatgcgatgggtaaatagtcgcatatcaatcatcggacgcgatgtcgcaagctgtgtgcggataaagagtcccaggagcagcgcgccggtaagcagggtaaacgagataacccacagcgacagatgccctttcagcgcggttttagcgctatagaccaacagcaaaatggcaataatcagcatcaccgcatggccaagattgagcggttgatcgcgacggcccgcctggcgaggaacatagcgggcggttaagcccatgacgaccagcacaatcggcacgttgatcaggaaaaccgatccccagtaaaaatgctctaataatatgccgccgatgagcggcccaaacgccgctccgcccgaacctaccgctgcccagacgcccagcgccatgttgcgatgcttctcttcacaaaaggtagcgcgtattccggccagcgtcgccggtacaatcatcgccgcgccaatagccagtaataccctggtggcgataagccaactggcggtatgcgaaaacgctgccgccaatgacgccaggccaaagagcgtcccgcccagcatcagcaggcgtttaaaaccgatacgatcgccaagtgcgcccatcggcaacaccatgccagccatgaccaaagaataaatatcaatgatccacagcagctcgttgccgctggcccccagtgtcatactcagtgtcggcgcggcgacatgcaagaccgtggcatcaatggcgacaggaatatagaccagcacaataatgactaacgttaaccactgacgaaacataactctcccttcaaaaactcaaatttggacgcttgtccagcttcaggatcctacggtaagttgaacgaatgtccagctttttgttacactgcgcgcattggctaatgtggggaaaatatgagttaccttaaccgggatgaacgccgcgaagtgatcctgcaagcggcgatgcgcgtggcgctggcagaggggtttgccgccatgacggtgcgacgaatcgcatcagaagccgatgtcgccgccggccaggtgcatcaccacttcagctcggcgggcgagctcaaagcgctggcctttgtccatttgatccgcaccctgcttgatgccgggcaagttccgccgcccgccacctggcgtgcacggcttcacgctatgttgggtagcgaagacggcggctttgagccttacataaaattgtggcgagaggcgcaaattctggccgaccgggatccgcacatcagagatgcttatctcctcacgatgcagatgtggcatgaggaaacggtcacaattatcgagcagggcaaacaggcaggagaatttacgtttactgctaacgccacggatatcgcctggcggcttatcgcactggtgtgcgggctggacggtatgtatgtactggggattccggaaatggccgatcccgcgtttaaattccatctggatcgtatgattacgcttgaactctttgcgtaaagttacaaataatttaataaaaatcgcttttaatttacaaatagtaacaattaagaaacatcatatctcctcatcgcgccgcgctggcctggttttttatctattctttcactcaatattctaaaaaaacttcaataagttctcaaaagagcgcgtgacgctctgtctcttttttgtgtttttcttcaaatgatatgcgcatgtgaggggtaaaatgacacgacaaaacgagaattataaccgttatctcttgagtgactggcgacccgaaaatccagccttctgggagaataaagggaaaggcatcgccagaagaaacttatggatttcagtaagttgtttgctcctggcattttgcgtctggatgttgtttagcgctgttgccgtcaacctcaataaaattggatttaattttaccaccgaccaactctttttattaaccgcattaccttctctttccggcgcaatattacgcgttccctactcctttatggtgccactgtttggtggtcgtaaatggaccgtattaagcaccgtaatattgattattccctgcgcctggctgggattcgccgtacaaaatcccgccacccctttcggggtatttatgctcatcgctctgttgtgcggttttgcgggggcaaacttcgcgtccagtatgggcaacatcagttttttctttccaaaagccagacaaggtagcgcgttgggtattaacggcggactgggaaatcttggcgtcagtgtgatgcagttgattgcgccgctggttatttttctgccgatatttacttttttaggcgtccagggcgtgccgcaacctgatggctccctgctcgccctcactaacgccgcctggatctgggtgccgttactggctgtcgcgacgcttgccgcctggtttggtatgaacgatatcggcagttcaaaagcgtctgtcgcctcgcaattgccggtgctaaaacgtctgcacctgtggctgcttagcctgctgtacctggcgacattcgggtcattcatcggcttttccgcaggtttcgccatgctcgccaaaacgcaatttcccgacgtaaacattctgcaactggcgttctttggcccctttatcggcgcgctggcgcgatcggcaggcggcgtgatctccgataaattcggcggcgttcgcgtaacgctcattaattttatctttatggcgctgtttaccgccttgctattcctcacgctgccaggctccggcgcaggcagctttagcgcgttctatcttgtttttatgggcctgtttttgacagcgggtctcggcagcggttctaccttccagatgattgcggtgatcttccggcagatcacgctctacaacgtcaaactgcgcggcgggagcgatgagcaggcgcagcgcgaagcggtgacggataccgccgccgcgctcggttttatctccgctattggcgctgtgggcggcttctttattccaaaagcgtttggcacctctttggccttgaccggctcgccggtgggcgccatgaaaatctttttgctgttttacctcgcttgcgtcctgctgacctggctggtctacgggcgtcgtaagcctaaacaacaataacaacatacgcacctgtaggacggccatccggtaatggtttaacgccaaatcgacaggatggcggaaaatttatcgaagcaggagaaatgtcatgagtaaactgttggatcgctttcgttactttaaacaaaaaggcgatacctttgccgacggccatggtcaggtgatgcataccaaccgcgactgggaagacagttatcgccagcgctggcagtttgataagatcgtgcgctcaacccacggcgtcaactgcacgggctcctgtagctggaaaatttatgtcaaaaacggtctggtgacgtgggaaacccagcaaaccgactacccgcgcacgcgtcccgatttaccgaaccatgaaccgcgcggctgcccgcgcggcgccagctactcctggtatctctatagcgccaatcgtctgaaataccctctggtgcgtaagcggctgatagaactgtggcgcgaggctctttcccggcacagcgatccggtgctggcatgggaatctataatgaacgacccgcaaaaatgccaaagttacaaacaggtgcgcggacatggcggctttattcgttcgaactggaaagagctgaatcagctcattgccgccgctaacgtctggacaatcaaaacctatggtccggatcgtgtggcggggttttcacctattccagcaatgtcgatggtttcttacgccgccggaacacgttatctgtcattgcttggcggtacttgtctgagcttctatgactggtattgcgatcttccgcccgcgtcgccaatgacctggggcgagcagactgacgtgccggagtccgccgactggtataactcagcctacattattgcctggggctctaacgtgccgcagacgcgtaccccggacgcccacttctttaccgaagtgcgctacaaaggcaccaagacgatcgccatcaccccggactattccgaagtcgctaaactgtgcgatcagtggctggcgccaaagcaaggtaccgacagcgcgctggcgatggccatgggtcacgttattttaaaagagtttcatctcgataatcccagcgactattttcttaactattgccgccgttataccgacatgccaatgctggtcctgttggatgagcgcgcagacggcagttatgtaccggggcgtatgatgcgcgcgtcggatctggtggatggactgggagaagccaataatccggaatggaaaaccgtcgcgctcaacagtacgggcgaactggtcgcgcccaacggttctatcggttttcgctggggcgaaaagggaaaatggaacctggaaccggtggcggcgggcgtcgaaactgaactgtcgctctctttactcggtcagcatgatgacgtggcgggtgtcgctttcccctattttggcggcaacgaaaacccacattttcgcagcgtgcggcaggaaccggtgctggtacgtcagttaccggtgaaacgcctggctctggcggacggtagcgagcggatggtcgtcagtgtttacgatctggtgctggcgaattatgggctggatcgtggtctggatgacggccatagcgccaataattataacgacgtaaaagcctacacgccggcctggggcgaacagattaccggcgtgccgcgtcgacatatcgaaactattgcgcgtgaatttgccgagaccgcccataaaactcacggtcgttcgatgatcatcctcggcgcgggagtgaatcactggtatcacatggatatgaattaccgtgggatgattaacatgctggtgttctgcggctgtgttggacaaaccggcggcggctgggcgcactatgtcggccaggagaagctgcggccgcaaaccggctggctgccgctggccttcgcgctggactggaatcgcccgccgcgtcagatgaacagtacctcgtttttctacaaccatgccagccagtggcgctatgaaaaactgactgcgcaagagttgctgtcgccgctggccgatccggctaaattttccggacacctgatcgatttcaacgtgcgcgcggaacgtatgggctggctaccctcggcgccgcagcttaatcttaacccgctcagcgtgaaagcgagcgccgataaagccgggctgtctgcggcggattataccgtgcaggcgttgaaatcaggcgctatccgttttgcctgcgaacagcctgacagtggtcataatcacccgcgaaatttatttgtctggcgctctaacctgctcggctcctccgggaaaggtcatgagtacatgctcaaatatctgctgggcacagacagcggtatccagggcgaagcgctgggttccagcgaaggaattaagcctgaagaggtggaatggcagtccaccgcgattgagggcaagctcgatctgttggtcacgcttgatttccgtatgtccagtacctgtctgttttccgatatcgttttgccgaccgccacctggtatgaaaaagacgatatgaatacctcggatatgcatccgtttatccaccccctttccgctgcggtcgatcctgcctgggaatccaaaagcgactgggagatctacaaaggtatcgccagcgtcttttctgaagtgtgtgtcggacacctcggacaggaaaccgatgtggtgctacacccgctccagcatgattccccggcggaactggcgcagccatttgatattctcgactggcgtaaaggcgagtgcgaacttattccgggcaaaaccgcccccaatatcgtcgtggttgaacgcgattatccggccacctatgaacgttttacctcgctgggtcccctgctggataaattaggcaacggcggtaaggggattgcctggaatacgcaagatgaagtcgatttcctcggtaagctcaattacaccaaacacgatggcccggcgaaaggacgtccgcgaatagacaccgcgctggatgcttcggaagtgattcttgccttagcgccggaaactaacggccaggtggcggtgaaagcctggcaggcattgggcgagatgaccgggcgcgagcacacccatctggccatcaataaagaagatgagaaaattcgctttcgtgatatccaggcgcaaccgcgcaaaattatctccagcccgacctggtcaggactggaaagcgagcatgtctcttataacgccggatataccaacgtacatgaactgatcccgtggcgcacgttgtcggggcggcaacaactctatcaggatcatgcgtggatgcgcgcttttggcgaaagcctggtggcatatcgtccgccgattgatacccgcagcgtcagcgaaatgcgagaaattccgcccaacggtttcccggaaaaagcgcttaacttcctgacgccgcaccagaaatggggaattcactccacctacagcgaaaacctgctgatgctgaccttgtcgcgcggcgggccgattgtctggatcagcgaagccgatgcccgtgaattgggtattgaagataacgactggattgaagccttcaacgctaatggcgcccttaccgctcgtgcggtggtcagccagcgcgtcccgccgggtatgaccatgatgtaccacgcccaggagcggattatgaacattccgggttcggaagtgaccgggatgcgcggcgggatccataactccgtgacccgggtctgtccaaaaccgacgcatatgatcggcggctatgcgcaactggcttacggcttcaactattacggaaccgtgggttcgaatcgcgatgaattcatcatgatcaggaagatgaaaaacattaactggctggatgatgagggccgggatcaggtacaggaggcgaaaaaatgaaaatacgctcacaggttgggatggtactgaatctcgataaatgtattggctgtcacacctgctccgtcacctgtaaaaacgtctggaccggacgtgaagggatggaatacgcatggttcaataacgtcgaaactaaaccaggcatcggctatcccaaaaactgggaggaccagcaggagtggcaaggcggttgggttcgtgatgttaatggcaagataaggccccgtctgggcggcaaaatgggggtaattagcaaaattttcgccaacccggtgattccgcaaatcgatgattactatgaaccctttaccttcgattatcagcatttacataatgcgccggagagtaagcatcagcccactgcccgccctcgttcactgatcgacggaaaacggatggacaaggtgatctgggggccaaactgggaagagctgctcggcggcgagtttgaaaaacgcgcccgcgaccgcaacttcgacaacatacaaaaagagatgtacggtcagttcgaaaacaccttcatgatgtacctgccgcgcctgtgcgaacactgcctgaaccccagttgtgtcgccacctgcccaagtggcgctatttataagcgtgaagaagacggcatcgtgctaatcgaccaggataaatgccgaggctggcgtttgtgtatcagcggctgcccgtacaaaaaaatctactttaactggaagagcggcaagtctgagaagtgcatattctgctatccgcgtattgaatccggccagccgaccgtttgctcggaaacctgcgtcgggcgcattcgttatcttggcgttctgctctacgacgccgacaggattgaagaagcggccagtaccgaacacgagacggatttgtatgaacgtcagtgcgatgtgtttctcaatccgcacgatccggcggtcatcgaagaggcgcttaaacaaggcatcccgcaaaacgtcatcgacgccgcccaacggtcgccggtgtacaaaatggcgatggactggaagctggcgcttccgctgcacccggaataccgtaccctgccgatggtctggtacgtaccgccgctatcgcccatccagtcatacgctgacgcgggcgggttgccgcacaatggcaatattctgccggcggtggaaacgctgcgtattccagtccagtacctggccaatatgctcagcgcgggcgataccggcccggtcattcgggcgctaaagcggatgatggcgatgcgccactacatgcgctcgcagacggttgaaggcgtgacggatacccgcgccattgaggaagtcggtctgagcatacaacaggttgaagagatgtatcgctacctggcgattgccaattatgaagatcgttttgtcattcccaccagccaccgggaaatggcgcgcgatgcctttccggagcgcaacggctgcggctttacttttggcgacggttgccacgggtcggataccaaattcaacctgttcaacagtagccgtattgatgccatcaatatcaccgaagtacgtgataaagcggagggggaataatgcaaatcctcaaagcgattggcctgttgatggagtatccggacgacgagttgtgggaatgtcgggatgaagcgctcacccttatccaacacgatgcgccaatgctggccgacttcactcgcgagctgctttatgcgccgttactggataaacaagcagaatggtgtgaagtgtttgaccgcgggcgcgccacttcattgctgttattcgagcatgttcatgcggagtcccgcgatcgcggccaggcgatggtcgatttgttaagccaatatgaaaccgtgggcctgcacctcaactgccgcgaactgccggatcacctgccgctctatctggagtacttaagcgtgttgccggaagcggaagcgcgcgagggattacagaatattgcccctattctggcgctactgggcggtcgcctgaaacagcgaggagcgccgtggtatcaactgtttgacgccctgctgacgctggcgggcagcacgcttacaagtgacagtgtcaccaaacagattattcaggaatcgcgggatgatacccgtcaggcactggatgccgtctgggaagaagaacaggtgaagtttatcgaagataacgccacgacctgtgacagttcaccgttacaccattatcaacgacgctttagccaggacgcggcgccgcagtacgtcgacgtcagcgcgggaggcccgaaatgatacagtacctgaacgtctttttttacgacatctacccctatatttgcgccacggtattcttcctcggcagttggctgcgctatgactacggacaatatacctggcgcgcgtcgtccagccagatgctggacaagcgtgggatggtgatatggtcgaatctgttccatattggcattctggggatcttctttggccatctgtttgggatgctaacgccacactggatgtatgcctggttcctgccgattgcggtaaagcagcagatggcgatgatcctcggcggcgtgtgcggcgtattaacgttgatcggcggcgcgggattactgtggcgtcgtctgaccaatcagcgtgtgcgggcgacatccactacacctgatattatcatcatgagcattttgctgattcagtgcctgcttggcctgagcaccattccgttttcggcgcaatatccggatggcagcgaaatgatgaagttggtgggctgggcgcaaagtattgtcaccttccgcggcgggtcttcggaaatgctgagcggtgtggcgtttgttttccgcgttcatctggtgctgggaatgactattttcctgctcttcccgttcacccgtctggttcatgtctggagcgcgccgtttgagtatttcacccgtcgctaccagattgttcgtacccgccgctaattctctttgcccggggatacgcttaccgggcaaagaaaaacgcctgggcgtcgtcattcggcaacgcacaggctatgatgattcttcagtcaaaggagaacatcaatgaaaccgcagatttaccatgttgacgccttcaccggcgacccctttcgcggcaactctgctggcgttgtcttacatgcggatacgctaagcgacgcgcagatgcagctgattgcccgtgaacttcgtcactcggaaaccgcctttttgctaaaaagcgaagagagtgatgtgcgcatacgctactttacaccgacagtagaagtccccatctgtggtcatgccaccgtggccgcgcattatgttcgggcaacggtactggggttgggaaacaccaccgtctggcaaacctcgttagcgggccgtcatcgcgttgaaattcatgccgaacacaacgactatcgcatcacgctggaacaaggtcagccctcttttgaaccaccgctagtcggagagattcgggctgccatcatcaccgcactgaacctgactgaagatgatatcgtgccgggagcgccaattcaggtggcttcaacaggacatgcaaaagtgatgatcctgctcaaaccagacgttgatattgatgccctttctcctaatctggcagccctgacggcaatcagccagcaaattggctgtaacggcttttttcctttccagattcgtccgggaaaaaacgaaaccgatgggcgaatgttttccccggcgataggaattgtggaagatccggtaacgggaaacgccaatggcccgatgggggcatggctcgtccatcatggcctgatggcgcatgacggtaaaacgctgcagattcaaggccatcaggggcgcgctttaggcaaagagggtactgttgatgttaccgtcaccattcgcgataaccagccggaaaacgtcaccatctccggccaggcggtcattctgtttcatgccgaatgggccattactttttaatctttgtcaggcccgcaaatcctcgcggcaaaaaattattttcccgcctctggatgggtatcaaatgcagccattaccgcggccagctccgcctcggtaaaaccgtgctttacatcatttacgccgagaccaaactgctgctgaagtaactgatacaacgacggtacatccggtacattgacctgttcaacggcatgtccctggtggtaacgcgtgaagtggaaattcgttaatgtcagcttgccgccatcaggcaaatggcggcacatcaacaaatgatgacgaaaatgggattgcggccagtgagccgaccagaaattgcccatcacatgatcgctctgctgctgcacccccagatcaaaacagtacatcgactgccagtgctcatggtggcggaattgtaaaatccatgtgcttccctcctgcatcaggcggtattcgccatgcggcgtttgctgggcaatttcagcctgcagacgaagcggtgcggttagcgtttggccgccaaaccccacgtccgcgatccactgctcatcctcaacatcaaccagcagcaaacggtgcgtgcgcggcggtaaactggcgggatgagacagaatgacccgccccaataagcttcggacgttaaaaccgatgtcgcgtaacgcgcgttcaaacaggccattcagttcaaaacagtatccaccgcgtcgggcataaagcagtttctcctctaatgccgtctcatcgagctgtatttcacgaggcagtagcacatccagattttcaaaaggaatcgcgcagttgtgcgctaagtgaagcgttctgagcgcttcaaccgtaggaacccccaacggctgacaatgtaatcgcgtaaaataagcatgtaaaaaagaggtcatctgaggcttccattaacattaatgcttgcgttcggcacacaggctgaggcggatatcgctgcgcaacaggataccctatccgtggaatagcgttggatacttttgaaaaaaataagacaggccggctgtcgcgccggaggtacgtggaattttggcgtacaaacggaaatcgggttctgagaatctctttgcgacacgccgccaaaatagcggcgtgttaaaatttttaacgccggctcagcgagtctgatttctaacaaaactggctaaacataaacgctttttaataattgtccaaatagttatggtagcgagcttttatgtcggccgcccattgcgctttcgcctcctgcatgttgctggcccgagcgatataatattctaaacacggaatggcgcctaatgcctgaggtaaggcattatatgctgccattcgctctctgacggttttatatttttcatcaatatcataatcatagtacgctggcgcttcaaaaaagccctcttccagtctcatacaaatctcttcaaaggtcccctcaacctcaacggtatgttccccatccgatatcctgacgattggcttaccttcagctatcagcgagagttgttcgaatgttaacatccgaccatcagaaagctcgacatctatagtaaacagtccatcacgtacagcatcagcaaggtgattatggatattccctgcattggcacagaactccgcaactttaggcgtaacattacaataatgttcaattactcgcgtaaatccgtaggccagtcctgcggtaagcacatacaagatgcctttcatgatttttgttgataatttattttcataatctcctgcagcaacatgaggtagcttatttcctgataaagctctggcataggtagaaactgatgtatatggcatatcctactccttcaaattttgctcaatagctttatatgtcctactcctctctcattatgacgatatgtcaatcaacaaaattgctcaaaggcatacattttcaggagaaaatgagaataacaggcgcaacggcctgatcttatgctgcttcaatatcgtcaggtggtttatcgttcgaggtcatatctatgaccataaatccctgcagggattaaccctgattaattattgcgcaacgcaatcactgccgatttgtgctggcgtcttatctggctgaatcgtgaccacaccgcaccacatctgaccacacaaataaactcgacatcctcattttgttctttccgtatgttttgcgtcatttaacaattgcaggtaggatgctccgccggcggttttatccctgtcacagaatcagggaaaagcggcattcgccattgcaggcaatcgattggtgagcgcccgtcgcggcataaggaatttttctgtcaggacaggctataacaggtaacgtaatgaaaacacagactacgcacgccgcagaacaacatgcggcgaaacgacgctggctgaacgcccatgaagaggggtatcacaaagcgatggggaatcgtcaggttcagatgattgctatcggcggcgcgattggcaccggtttatttttaggtgcaggcgcccgattgcaaatggccggaccggcactggcgctggtctatctgatatgcggcattttttcttttttcattttacgcgcgctgggcgaactggtattgcatcgcccttccagcgggagcttcgtctcctacgcccgtgaatttttgggtgaaaaagcggcctacgtcgcaggctggatgtactttattaactgggcgatgaccgggatcgtcgatatcaccgcagtggcgttatacatgcactactggggcgcatttggcgacgttccgcaatgggtgttcgcgctcggcgcgttaaccattgtcggtaccatgaacatgatcggcgtaaaatggtttgccgaaatggagttctggttcgcgctgataaaagtactcgccattgttatcttcctggtggtaggcacgatttttctcggtaccggtcaaccgcttgagggtaatgccaccggttttcacctgattacagataatggcggctttttcccgcacggcctgttgcccgcgctggtactgattcagggcgtggtgttcgcttttgcttcgattgaactggtcggtaccgccgctggggagtgcaaagatccacagaagatggtgccaaaagccatcaatagcgtgatctggcgtattggtcttttctatgtaggatcggtcgtattgctggttttgctgctgccgtggaacgcctaccaggcggggcaaagtccgtttgtcaccttcttttctaaacttggcgtgccttatatcggcagtattatgaatatcgtggtgttaaccgccgcgctttccagcctgaactccgggctttactgtacggggagaattttacgttcaatgtcgatggggggttccgcgccgaaattcatggcgaaaatgagccgtcagcatgtgccctatgcgggtattctggcgactctggtggtttacgtggtcggcgtgttcctgaattacctggtcccctcccgcgtgttcgagatcgttcttaattttgcctcgctcggcattatcgcgtcgtgggcgtttatcatggtgtgccagatgcgtttacgccaggcgataaaagaaggcaaagccgcagacgtcagttttaaactgcccggcgcgccttttacctcctggctaacactgctgtttttactaagcgtgctggtactcatggcgtttgactacccgaatggaacttatactatcgcctcgttgccgctgatcgctattctgctggtcgccggctggtttggcgtgcgacgtcgcgtggcggagatccatcgcactgcgccagtgacggcggattcgacagagagtgtcgtattgaaagaagaagcagcgacataacattccccttccccggcagccccaggcctgccgggtttaatgcgcgttgccgccaacaccgcatcgcgcccaatgcttagtcagccttaatcaactgcgccacatcattgctgttaatttcccgctggttgccttcctgatcggtataactggtcatccccgtctctttatctaactgcggcttaccctgagttacgatcgtttgcccattcttcgtcgtcatcacatagttggttgtacaacccgcaagcataaaaaacatcatgcccaaacctgagcatataaataactttttcatattttcctcgtgaatataatgagttaactacagcaaaaaggcagtgtaattctcacagaatcatcaggctatcggcggggtgtaacgaggcgtatcggtgcgtttaaagagatgactggaggggtttccccctccataccctatttacagagcaatgcgaataacatcatccggctgcgtcgcttcctgttcacgtgtcgatttctgcttcacgctgacgtagagcgttttaccgtctgccgatagcgccaggctattcgggtacgtcggcgtatcgaacgttttaacaacgttataggtcttcgcatcgatcacgctgacctgacctgcctgacgatgtgtcacatacgcctcgttacgtgtcgggttaaacaggacggccaaagaagcaggcgccgcgattttggcaagaatattgccattacgggtatcgacaaccagaacctcagtcgccttcgagtcggtgataaacgcgcgatgacctgcggtatcgagactcaggttaataaagaagtgttctttaccgtcatccagcaacttcttacgactgagaattttattgctggcggtatcgatagtgataaattcgccatccgcattggtggtgtacaggcgttgcgctttactgtcgagcgccagacccgtactcattttgccggtattttcgatcgtcgttttcagtttgatggtttcgccatccactacccaaatagcactctctttaccaacaccgctaatgtagatcgtgttggtcgccgcatcggcaaccagctcacggggctgtaacggacgaacctcttcagtacgtttgcgcgcatcaagtaccagacgaccttttacatcacccgttttggcatcaatcgcggtaactgcgctgttaatggtattgccaaaccacagcgtttgggtcgcggcattgatggtggcgccgaacggcttgagatcgttatgaatcgcttgcgtgatttccagcgtcaccgggtcgagacgataaactacgccgcctttatccagtttacggctttgcgatgtagccagccagagcgcgttttcttgctgactccaggccatctcataagcgcctttgcctaccgctttacgcagcatgtcttccgccgccagcgtgctaaatgaggatgcgacgaggagcgaacctaacaataaagaaccacgcaggcgcggcgaaaaaagatgacgtaagtgcatgacgactccctttgataaaaacgtgtatagctgcttcacactacttcgctgcgcgggatcttcgttccgcacttattataagttgagaataataatcattatttatcagaaagtggagcttttcctcgcctgcgaatgtcatggctcttaaataccgcacattttcttaacttaatgtgcgattaaaatttcaaaactttacatattgactacccttaatgtcacgttttccgttgatacgcttacatttatccggcattttcatgaaaattatttccgttagacagcgactttatcccgccctcttattgcctctgaccttctccccggtccttcaggccgccagcgcgcccaatgaacaaaccatgatagtcaccgcaacgccgcaaaccgtatccgagctggatacacctgccgccgttagcgtcattgagggagaagacatgcgtctggcgacgcctcgcgttaatttatctgagtctttaaccagcgtcccgggattgcaggtgcagaaccggcagaactacgcgcaggatctgcaaatctctatccgtggatttggctcgcgttccgcctttggcgtgcgcggcattcgtctgtatgttgatggcattcccgccaccatgccggatggacaaggccagatttcgaatattgatattaacagcatacaagacgttgaagtgttacgcggccccttctcagcgctatacggcaatgcttccggcggcgtaataaatgtcaccaccgaaaccgggagacaaccgcccacccttgaggccagcagctactacggcagttatggaagctggcgctatggactaaaagccacgggcgcgatgggtgacggcacacagccaggcgacgtgtattacacggtatcgactacccgtttcaccacccacggctaccgcgatcacagcggcgcgcgaaaaaatctggctaatgccaaactgggcgtgcgccttgacgatgtcagtaaactctcgctgatttttaatagtgtggacattaaggcggacgatcccggcggacttaccgaatctgaatggaaagccgatccgcaacaggcgccgcgcgctgaacagtacaatacgcgtaaaaccatcaaacaaactcaggcaggattgcgttatgaacgtcagctcagcgcgcaggatgatatcagcgtgatggcctacgccggagagcgggaaaccacgcaataccagtctattcccctggtggcacagctaaaaccagcccaggctggcggcgtaattacactgcaacgccactatcagggcattgattcccgctggactcaccggggagaattaggtgtgccggtcaccttcactggcggagtaaattatgaaaatatgagcgaaaaccgcaagggttacaataatttccgtctcaacaacggcacccctgagttcgggcataaaggcgatttacggcgggatgagcgtaacctgatgtggaatgtcgatccttatctgcaaacccagtggcagcttacgcaaaaactctcgctggatgctggcgtgcgctacagttccgtgtggttcgattctaacgatcactatatcgcgcccggcaatggcgatgacagcggcgacgccagctatcaccactggctacccgccggatcgctaaaatatgcgttaactgacgcctggaatctctatcttgctgccggtcgcggatttgaaactcccactatcaatgagctttcttatcgcgctgacggccaaagcgggttcaactttgacctcaaaccgtcgaccaatgatacggtggaagtcggcagtaaaacgcggattggcaacggcttgttgaccgccgcgttatttcaaaccgataccgatgatgaaattgtcgtcgccagcagtatgggaggacgcactacctacaaaaacgcgggcaaaacgcgccgccagggcgcagaacttgcgttggaccagcgcttcgccggcgactggcgggtgaaagcatcatggacctggctggatgcgacctatcgcagtaacgtttgtcaggggcaaaactgtgatggaaaccggatgcccggcatcgcccgtaatatgggattcgcctcattaggttttatcccggatgaggggtggtacgccggaacagacgttcggtatatgggcgatatcatggccaatgatgaaaataccgccaaagcgccttcgtataccgttgttggactaaatacagggtataaatttaattacagtcagcttaccgtcgatatttttgggcgggtagataatctatttgataaagaatatataggttcggtgatcgttaatgaatctaatggccgatattatgagccagcgccagggcgtaactatggcgtggggattaatctggcatggcaatttgaataaatatccggcaaatatccggcaatagcggggaatccccgctattgataagtcatagtttcatgaaagttacatgaagtactgatttttaatcgtcgctacgttttgttgcaaaacgttctgtaggcagtggcgactggcttctttatcaccagtcactaacgcattaagcaattttctgtacagattaacgccgttttgataatcatcaagtttaaaattatcatataaaaaatgcagacttggccccaggcgtacccataattgctcgatcatggcatacagcgttggcatatccgcgtagtggtagatctcaaagcggaatgcgcggttggccaaaagaattttctccataacgccactttccagcgcctgttgaaattcatctaatagcgcattcagcgtctgctcgcgatccggggtaatcttacccgcagcggcgaccaccgccatctcctccagggcagtacgaatcgtattaatttccagcaaactttccagcgagatctccggcaccataaacgcctgtgctggcgccaccgccaaagcactggaagagaccagccttaacagggcctcacgcaccggcgtaatactgacgcctaactcttgagcgatatttttagtgataagccttgcgcctggttttaatgcgccaatagacaattgatgctttaaccgattttcaacctgtgtggtcaggcttatatgttgtgttttttccgtacccggcattttccttccttcacctcttggcagaacaacatcgcaatcgagtcccgaagaagtttcggaacttaattgtaaaaaagataatccaggcctgaacggccaaataaataaaagtgataatttacttgcgtgatattctcatcttttacaacaatacaggtttctttatggcaaccgttttatctccgtcattccttcatgtatcgagatttttgaccggttcaggccgctgagggagataagctgccccaccgcgatctgaatgatgaatataagtaaagccgcaattttaaaatttgcacatttttatggcgacataatgccgccattttttctttacgcatcgtccgctaaacgtatcacgactttgccaaagttcttccccgccagcagccccataaacgcttctggcgcattttccagcccatcagtaatctgttcccgataatgtattttcccttctttgatccaacgccccatttcttgctgaaactcatgtatccggtgaccatagtcctggttgatgataaaaccttgcagacgaatacgctttttaagtaatgtcgccatcagcagaggcagtctgtctggaccgtccggcaacgctgtcgcattgtagccgctgaccagaccgcagagcggaatccgcgccgacgtattcagtagcggtaagacggcgtcaaagactttaccaccgacattctcataatagatatcgataccctgcgggcaggcctgcgcaagctgttgtgggaaattatcagcgtgatgatcaaggcacagatcaaatcccaaaacgtctgtcgcatgacggcatttttccgcgccgccagcaatacccacgacccggcagcccttcagcttgccaatttgcccaaccgttgcgcctacggggccggtggcggcggcgacaaccagcgtttcgccctctttcggctggccgatatccagtaaccccatataggcggtaaaccccggcattcctaaaatacccaatgaccaggaaggatgttgcggattatcacccagctttaccaacccttcgccatctgaaatgtcataatcctgccaaccattgtaactcaacacccattcgtctggtcggtaatcaggatgattcgacgcgacaacgcgactgaccgtaccgccaaccataacgcagccaggttcaacaggcggcgcataagagggttcatcgctcatgcggccacgcatataagggtcgagtgataaaaaaacggtacgcaatagcacctgcccttcaccgggcgtcgcgacgtcatcttcttcgaggcggaagttatccatctgcggcgcgccgtggggacgcgaggccaaaacccaacgacgatttcggttggtctgttgcttcattctattctcctcatgcctggcataatccatcaataatagtcgaacattagctttctgagggagttaaacactctcagatatcaggctgtgcgcttttatgaacgactttctcccccttctcgctaaatatgaattcttgcgctaattcgttgatttatgccgccttcaatagtatttctaacactatcgtaaacattccctggggttccctatgacgattcgctttgccgataaagcagactgcgccgcgattaccgaaatctataaccatgcggtattacatactgcggccatctggaatgatcggacggtcgatacggataatcgccttgcctggtatgaggcccgtcaattactgggctatccggtgctggtaagcgaagaaaatggcgtggtgactggctatgcatcatttggcgattggcgcagtttcgacggttttcgctataccgtcgagcactcggtttatgttcatccggcgcaccaggggaaaggactggggcgaaagctgctcagcagactgatcgacgaagcccgacgctgcggcaagcatgtgatggtggccggtattgagtcacagaatgccgcctcgatacgcctacatcattcgctgggatttaccgtcaccgcgcaaatgccgcaggtcggcgtaaaatttggccgttggttagatcttacgtttatgcagctccagcttgatgaacacgccgcgccggacgcctgctgatgaaccagtcgctgacgctcatctttttgatcgccgccggtgtcgggctggtggtacaaaacagtattatggtgcgtattacgcagacatcatcgacgattctgatcgctatgctgttgaactcgctggtagggatcgttttatttgtgacgatattgtggtttaagcaaggcgctacgggcttcggcgagctggtcgccagcgttcgctggtggacattgatccccggtctgctggggtcattttttgtatttgccagcattagcgggtatcagaacgttggcgccgcgacgactatcgcggtactggtcgccagccagttaatcggcggactggcgctggatatcgcgcgtagccacggcgtcacgttacgcgcaatggtcgggccggcgtttggcgcgctgttgctggtcattggcgcatggctgattgcgaagcgccagttttaatgggttacaggatcgtgccgcctttggtgagctgctcgcggcgcgcgtcccgatcttcttgatattgcctgccgtgatgcgcgatagccgtgcgtaaacgctgctgctgcacataacgatcttcgcgacgtaattcagcgtcatcgctcaaggcaatcagcaattcattcatatgggcaattacgctctccgcgatggcggcatccacgcgggcgctcacttcctccaggtgcgacataagctctcctactctttattctgtaacagcatgattcgcctattatacgcgttattgtcgcccgatgcggtaattcgccgccgccaccctgatttaacttacgtcaagtggaaacacggggcttaatagaccgagaattcgcgcctttttgcctttcttccgccgtttgcttgcgtatagaccccgtaaagtagacgcgtgaagaagtctaagggataacaacgtggcaaaatctctcttgcgcagcggcaatctggatgattatcaggccgtgggcggcggcggtcaggccgtatttgaatcagcattgcaaattcgcgaaacgcttcgtctgcgtaaacagcaggcgatggttgactgtctggcgattccgcaacttaacgataatggcgatcgggttgactggtattcgccgattgaaggtcaggcgatagcgtggaaagcggctgacgaagagacacgttctcgggctttacgttatttagccagcacttttgaaagcgcggctgcactcagtcgcaaaagtctgcaatccggtaaaacagcgctccagctatttggttcgctacttgagaaagcgacgcaatttcccggtgaaaatcatgttttcctggttaacggcaaaccggttatcaccttctggggattcgttaatctcaacgaaaatacacgcgatgatgtgctggactgcctgcgggtaaccgaggcaatccccgacatccctctggtcgagccggagcccgaagaaaagccgctggtagaggcggcatttagtcaggcggatgaacctttgttaacgtctgtcattgagccgccgaaaatgccggaggaacctgctgcgccgcccgttatcgttagcgagccgaagcctgccgcacctatcccggttgctgaggcgaaaagagctcgtcgtctaccgctgtggagcttacctgtcgctgccgtggttatcgccgccgtcgccacgccttttttctggccatcttcatccgttgacggggcctctcctgttcgcgccgcgcctgtcgctaccgcgaaaactgacgttacccccttgcctgaactcaccgcgcatttgccgctgcatcgcgctgaggtgacgcccgcccccaaagcggcgccgttgccggaagcgcctgttatcattgccgctatccccaaagacgcgctggtgatggacaatacgcagatgaagcttggaaccacgcgctttttaaacggtagctggcgcatcagtgtggatgtcaaagatccgattaccggcaagccgccctctctgcgttatcagatccaaaataacaaaggcatcgcgcgcgtagtacatggcgataacgtggtttgtcgggcggaaattttctctggtctgcatcaaacgggcgagctgatgattaaaagtcgcggcaatgcgcgctgcaccgacggttcacgttatccgatgccggaaattacctgtaaagcaggcgtcaatgacgtcgcaacctgtaccgcccgttatggcgaccacgcggcaattccgttgacgtttaaaaagataggtgcctgattttatgttggtcaatctgtgtgattacaaacagagcgtcacgctcattgcaaacagcggcgtccagtttcttgattttggcttaacgccgcaagagtcggcccactacggacgttttgtgcgcaaaacggcaaacggcccgctactgcgcctcgattttgatctgaccagcgggcgctacacgttgccaggacgtgctggcggccaacccgaagtcgtgaaaccggaaagcactcagacgctgcactattctctggatgtactcgacggaatctggctccccctgccgttcctgcgttttaatccgccgcgtacctttattgacgggccggataactgggcgcgcattcaggtacgtaaactcagcgagccagatagcgccggaaacacacaccgcatcaccctcgccttcgacagtcagctggcaaaaaatatgcctgcggcgttggcgccttgcgaaaacgatctgctcaatggcacacgttttgcgctcgcctggcgcgatgaagaagttgccgattttcttgaccagacatggattgacggctggctgcgcgagtcgtttcttcagtatgcctcacaggtggaaaaccgttcggaacaggccattcagcaagcgctgcgtagttttgagtatcaggcgcactggttgaatttactgacgctgttaggcgaacagcttacggtgccggaagtgaagtttgtgacacatacgttaagcacgcccgcaatcccggtcgatctgattctggatgtcggcaatacgcatacctgcggcgtcttgatcgaggatcatggcgatgcgaatgacgggttacgccagacggcagagcttcaggtgcgttctttaagcgagccgcagtatctgaacgatcctttatttaccagccgggtagaattctcggaagcacgctttggcaagcaacacttttctgtcgaaagcggacgagacgacgcctttgtctggccttccattgtgcgtgtgggcgacgaggctcgcgcccttgctatgcagcgtgtgggcaccgaaggcagcagcggtatctccagcccacgtcgctacctgtgggatgaaacccccgccttgcaggactggcgttttagccagatccacggtaaaacgcagcgcgaaccgcttgccaccgcgtttccgctgatgaatctgatgaacgatgacggacagccgttattccgcctgccgtatgaagaaaggctaccggttttttcgccgcaatacagccgtagcaccttgatgacgcatatgttgtgcgaaattctggctcaggcgctggggcaaattaacagcgtcgccacccggctgcggctcggctttcccgcctcgccgcgccagctacgcaccctgattttaacgctgccttccgccatgccgaaacaggagcgagaaattttccgccagcgaatgtttgaagcgctggcgctggtctggaaagccatgggctggcatccgcaggatgaggatttcaccacgcctaagcagcgtgaaaaaagcgtggtgccggtaccagaaatacagatggaatgggacgaagcaagttgcggccaactggtatggctttataacgaagccatttcgcattacgccgggcgtaccgaatccttttttaatgcgctggccagaccggatcgccagcctgaacccggcgtcgtccccgggcgcgcgttgcgcgtggcatcgattgatatcggcggcggcacgacggatatggcgatcgttcactatcagttagatgacggcgtgggggccaatgtaaaaattacgcctcatctcctgtttcgcgaaggttttaaagtcgccggggacgatctgctattagatatcattcagcgttgcgtactcccttccctgcaaacggcgttgcaacgggcaggcgttacggatgccgccgccctgctggcgaccttatttggcgattcgggacgaattgatactcaggccattttgcgccagcaaacggcgctgcaattatttatgccgctgggccatgcggtactttccgcctgggagcaaagcgacattaacgatccgtttgccggtttacatgcgacatttggcgatctgctgatccgccgcccaacgagcaacgtgatgaactatatccagcaggcgatcgatcatgccttaccgtctggttcgccgacatttgatatattcaatgtgccgttgcaaatccagtttagccagcttcaggagtctctgctggccggtcagtttacgctgacaacgccgcttcatgcggtctgcgaagcgatatcccactatcactgcgatatcttgctggtgacggggagaccgacctgtttacccggcgtacaggcgctcatccggcacttacaaccggtgccggttaatcgcattgtgtggatggataagtatcaggtacatgaatggtatcccttcagtcaacaagggcgtatcggtaatccaaaatccactgccgcggtgggcgcgatgttatgcagcctggcgctggacttacgtctgccgcgtttcaattttaaagcggctgatatcggcgcgtattcgactgtacgttatctcggcgtactggataataccgttaatacccttcgcgatgaaaacatctggtatcacgaaatcgatttggataaacccggcgcaacgctggacgctcgcttgcattttccgctacgcggtaacgtgacgttgggctttcgtcaactggcgaacagtcgctggccagcaacaccactttattgcctgagcattaattccgccgaactggcgaaaaccatcgctggcgacggcgtactgaatgtgcgactgaaattacgcggcagtagcaaagatagcgccccggaatcgttcatattaagtgatgcctggctccaggacgggacgccggtcgccgccgatgcgctgacattaaaattgaatacgctggctgaccgtcgccacagcggcagccactactggatagatagtgggagtgtatacctgaaatgacaaaaccgttaaacaccacccaggctgttatcgagtgggttaacaacacgcgccgttacgcaacgcgactggatgacgaagccgacgctctgctggcgcaacttacgcttgccgcggcggatgagtcagcgctcaacgccgcctgcgcatcacatggctgcgttggtctgtacgggtatgcgcaatccgcaaaagcgcatctgttaacgacgctatgcggtaacgagaatggcaagctggaaattatcacgccggaccgtgactatgattatttcagccacatcaatccgggtcatgcgccagcgaatatggctattcgctttacgcgcgacattttttcaaacgagagcggctggccgttgcgcctgcgcttgatcagtgaagccgaactggtgcagatctttattgcctggaccagctcgtcccccgtttgtcgccaggtcgaaaaatccattatcacatcacgcctggagaaatggcaatcgcttcgccaaccgcagcccgtccccggcgttaccgctgaagaggtagcgaccatcgcgagtttctggcgctcttgcctgccgtccgccagacaacatattgatgatgcgacatggcaacactttgcctcgctcttgcctgcgctggatctcacgacacgggcgcacgcctgggcattactgtggggagagcaaccggagatcacccagcaatggctggcgctggcgcatatgttgcaacaaaccggccatgccggggaactggcggcgccgctcagcctgctggtcgatcattttggcttaccggcggaaaacttcctgacgcaaatggcgctaaccgccaacgatacgcaaagcgatgtggtggtgcatccggttaaggaaggccgactgctcaatgcggtcagcctttcgcttgattctctggcgctgcttacccgcgaactggtgctaagcgttgaaaacaacgtactggataacgtagatttactggatattccggtcgcgccagacagtcatcctcatccgttatggcgggcgaaattaggttggatgctggcccattaccgccaacaggtacagcccgatgttctggtgatttgcaatgctctggcatctcgctcgcaaacgtccactgccgcccatcacttactggagtgggttaacgccacgcagccgcagcatgaatcagcgttacccggcgtcgtctgggctattactccacaggatgcccgttttgccacccagcaaaatctggatgaagccgtccagcagttgatgggtaaacctggcgtgcattggggaacgttgcaggcgctggataaacacagtatgcagcgtttggtggaatggttatcgcaggcgacatcggcaccacagcgacaggcgcgcttacaggcgttacgcgaacaactgcgaggccgcgtgcgcgatctgttaccgatgtttgatgacgcgcggctaccggttgaaaccgtgatccggcgtcttcaggcccaggccgccagacatggcgacctgctggccgggctgttaccgccggtacagaacttcgaagcgttgctgagcacccgacagtcacgagaagaacaggtctgcggtttatttaatgacgcgatcgatctctttgccgacgaaccaacgcgcgcttcagcgtcagaaggtcacgaaacaggctaccaggcgcacaaaatgtggatcaatcatctgcgccagtgggcccactgccgggataatgcgcagcgtctgggactggaaccgcagatgctcaacgccgtggcggagattttaattaccgccagctatcgcctcggtttacctcagcagttacagaaaaccatgcagcgcgaggaggtgagcggcgcgcagcttcatgccatcattggtaacttcatcgcctggctcggctacgccaatatcgaggaggcccaacgcccggccagccgcgttcagaaaggcgcagccattttcgccgcaacaccgcgttcgacaatgttgcgtctaacaaagcttgacgaacagcccgttcatgccgccagccgctatgtctatgactggcttgttgcgctgtataccctggccaatgagaacgcaggatatcggcatccgcaggacgttaccgacgtagacagagcgcaattaattgccctgatagcctgacctggcggaaaaaccatgcccggtaacctgtatcgggcttgaggtcagaaaagcgaaaacagcaatgcgacggggaaacttatcggccatgtcgcgccaaccaaaaaggcgctcaggaaacgaattcgttttttgtcatgagtcaaaaaccaggtgatcagggatgatatcaccgccatgacggcgtaaaaaattaatatcttttgaaagagggtcatatcaggcatccacgccaaccagaggaaaaaacgcgcgcaatatgctctttttatttgacgcacatcaaggtttatcagccttaacagcaaaacgttctcaatgcacggctccgctcacagaatatcctgtttaggtattattgcggatctcgccaacccgtactatacccataggggttatgatgaaaggtggcgaaaatgaatgtttccagtaaaaccgtcgtgctgattaatgtctttgctgctgcaggacttttgggtctgatctcgttgagattcggctggtttgcttgaggtgttcaacctttgagtacttgctgcgcatgttggcggggaggtccccctctccgccgacacccgcctattttttcacgatttttctgaacagtaaatgatccttaatgcttaaccatgatgtggcggacaagggtgtagtcttccagaccatacaatgacatatctttgccgtatcccgactgtttttgccctccatgcggcatttcgctaaccaacatgaaatgggtattaatccaggtacagccatactgcaatctggcgctaagccggtgcgcccgcccgacgtcctgagtccagacggaggatgccagaccatagcgagaatcgttggcccacctcagaacctgatcttcatcatcaaagacggttatactgaccaccgggccgaagacctcgcgttgcacgatggcatcttcctgttttgcgtctgccagcaacgtcggagcgaaatagtaacctttaccttccgtttgacttccgccagtaatcacacggatatggctgagggccttcgcctcctctacagccgctgtgacgcgcttcaggtgcgccagcgaacttaacggccccagctctgtcgactcatcctccggcgcgcccattttcaggctgctcactgcgttccctagcttttcgaccagcgcatcatagataccgcgctgcgcgtatatacggcacgccgcagtacaatcctgtccggcattatagaaaccaaaagtccggacgccctgcgccaccgcatccagatcggcgtcatcaaaaacaatcaccggggctttaccaccgagttccatatgcgtacgttttatcgctggcgcagtatggcgcagaatatgctccccggtcgcgatagaaccggttaaagagaccatgcgtactttttcatggccggtcaatacatcgccaacagtttgccctcgtccgaacaggacattgagcacccccggcggaaagatatccttcgccagcacggcaagtttaagcgccgtcagcggcgtgatttcagaaggcttaatcaccacgcagttacctgccgccagcgctggcgccagcttccaggccgccatcatgagcggataattccacggcgcgatagaggcaaccacgccaatcggatcccggcggatcatcgacgtatgtccttccagatattcgcccgccgccagcccactcaaacaacgggccgcgccggcaaaaaagcgaaagacatccacgattgccggaatttcatcattaattacgcagtgcaaaggcttaccgcagttttgcgattcaagccgggcgaactcaagggcgttttgctcgatgctgtccgccagttttaacagacattccgcccgtgctttgggtgtggtctgcccccattcggcaaacgcgttatcggcggcctgcactgcggcgtcaacctgcgcgggcgacgcttccgcaatctcaagtatgacctcgcctgtcgccgggttataaacagactgcctttctccctcgccgtccaccagcacgccattaatcagtaattgatattgcatagcattttcccatatcgtcattaatcgatttccggcgaacgggccgccgctttcctaaaaatagacggcgcgccagatgctcacccggcacactcgggaaatttagtcaggttgtgagctgacacgcattccacctcacacaaggcttttagcgctcagcatctcgcgaatcaggctgccaagctgttttacggcctgttcttcccgttctccccaatgccatgcggtgttaaaacgaaagaaacgcgtccaggcgccggacgttgaaaacattttccccggcgcgatactgataaggtgttcaagcgctttggcgctaagttcaccggcatcaagctgctcaggtagctccagccaaagaaaataaccgctatcgttatggtgaatttttacttccgccgggagatggcgcaaaagggtttgccaggcttgctgtttacgttcggcaagctgccttcgcaatcgtcgcagatgcgcgtcatatcgacgtgtcgagagataatccactaacgccaattgcatgggggaactggtggataatgtgctcattaactgcaaacgctgaatttgtctggcatggcttcctcccgcaacccagccaatgcgaaaaccgggaaccagacatttggaaaaagacgaacaatgcaacacggtatcgtcgcgatcccatgctttggcaggcagaggtttctcgcggccaaagtagagttcgctataaacatcgtcttcaattagcgtcacgttatggtgcgtgagtaacgcaaccagccgcgcttttttctcagcactcagcgtgaaccctaacggattctggctgttggtcattaaccagcacgctttcaccggatattcctgtaacgcctgttccagcgccataagatcgataccttctttaacatcggtaggtatcgacaacgctttcaggcgcaatcgctccagggcctgtagcgcaccgtagaaacaggggttctccaccaccacccagtctcccggcgccgtcaccgcctgtaaactaagattcaacgcttccagcgcgccggcggtaatgacaatctcgtcaggagaaacggtaatcccctgctgcgcgtaacggcgtgctatcgcatagcgcaattctgcattacctggcggcaagttttcgatgacgctcattgccgtcgcggttttgctgacctgcgccagagagcggttcaattgcggcaagggaaacagacgcggatcgggaaacgctgaggcaaagggcaccacagaggtatcacggctcgcctgcagcatctcaaaaatataggtattgatatctacggcttcatcccgaataacgtgcgctgccgtcgcgactgaccgacaaaccggatgcggcgcgacataataaccagattgcggacgggcgataatccgtccctgactttccagcaactggtacgcatgaccgacagtcataaaactcatgccgctactggcgacctgctccctcagcgagggtaatcgatcgccgggttgccaaacgccagaggcgatttgttctctaatttgctccgccagacgttgatattttttcattattcgatctcattgagcgctgcttgcaggtggcaaccgcagtgtatatcagttgttaaaattaacaatgatttgctaactgttatggtgctttccaacaggcgtaatgattagatttcgcaacaaaacgccgtttcagggtctctgcttaacgggaaagtcaaaccaagtgttcgggtatggttcatgagtaagagagaagtgccaccattcagtatccagtggcgtaaaacccgcatcacgcatcaatgtttgtaataacaacctatttgcgcgttgctgagcggtaagtatgacattatcgggatgggataacggactaaaacagtcaaagccggtaccaaaatccagactattatctggcgagcgttgcgccgcggacgcagtacaattcaccagtggtcgtccgggatcgtatattggtattttactgtcaagtggaacaatcgttagatcaagcgtacttccccgactgtggccggatctggcggcaagataaccttcctcaaacagacgatttttctctacctgcggataaaattcgtttttcatttggttttgagaaggatctttggcccacgcgataaagtcgttcactgcgctttgcggacggtagcaatcatatatttttaaggtaagtccgaaggggcgtaaacgatcggcgacctgcttcactgcgttcgcggctggtcgtgttaacaggcaaacaggcgcgttatagcctttaatggggcgaccaataaagttatgggaactgaagtatcgcatgtctacctgtacgtcgggggcgaccgtagtaatatcgacaaagtcttttggctggtggagatcaatatggttttcagctgacattgcctgaacggacaacaggctgaacaggaggaaagaagatacgcattttaccatatgttacacctcgcgagagtcacaggggtgattatgtatttgagcaggtaaagattagcggacaccgcttaaacagatggttaaaataaacatctttccccctgtaatctgtgccttatcacaaacggagagtttatattttgcttatacgaccactgcgcctcctgttctatacccaaaataattcgagttgcgtaaaggcggcaagggagtgagtctcaggagcacagataacgatgtgttttcacaaaggcgagtctacctgaccagaaaggtcatttgataatcagtagtacagttgttgtcgccttccataactaaataacattgtttcgccaaagataagaccactatatagtcaggaaggcaattagtgaggaacacgtcgattgtcggcgataatgcactgaaattacgattcactgcagttgtgcaaacacatagaatccccctcgaaccgagataattcggtctgctggtcatagccattattcagtaagaccgcaggttgcagcggcggatcacgggcgtgaagaaacatcctgtgccccaaattttttggacaagcgctgaacctgccgtatacttttacttaacgtacactccgccataaaaataaaccctgcgatgataccgtaatgccataggcataacttaaggatatgccataaatcaagcgaagcatgatttaacttctcagtaattgcgatagtctgtacaaatattatgggatgaaataataagatgcctaacaaaaatatccctgccacgatcatggcaagtaactgaaaaaaagcccatccgataacgaaacggtaaagtaacagcaataatagccgtccacatttccttagccattctgactgcaaaatgccccaggatgctgtcttttcgtgaatttcaccatctgatttcttcattttgagcctcctcgcaggtttttataattttatcgcccaactggaaacaaagccgtcagctaatcgttacaacaaatataattaagacaaaaactaaagagtaagatatttatatcataagcactatcagtattggccttctgccctaccgctaaacatctcattgttgttagcctaataatacttttagtttaacttcttataagacaatttctacacggttgagcaactatttactttctctaaaaataatatagtgcgtaattaatcattactcatagtacatgatgatgtgagaattaagaaaaccgttttactttcattcgttttatctgacatatttcatggccaggaggcgtgggcatgactaaagctacgggtcgatttgaacaattgaacaataatgttgacggttcaggacaaagcaaaaatcaggtgtttcaccgataggcaaaccgatgggcaacatgggataatatttcgaataccacctattccagtaatgaagtatcatataatcacttgtggtctacattatgccaattactatcgggagaggatttttaaagagtgagatgttttctcaaagtgctatctctcaacgctctttctttacgttactatgggaaaagattaaagattttttttgtgacacgcaaagatccactgccgatcaatatataaaggaattatgtgatgttgcctctccgcctgacgcgcaacgtttatttgatttattttgcaagttatatgaattatcatcaccgtcatgcagaggaaatttccattttcagcactataaagatgctgagtgtcagtatacaaatctctgtattaaagatggcgaagatattccgttatgtattatgatacgtcaggatcactactattatgagataatgaatagaacagtgctctgtgttgatactcagtctgcccacctgaaaagatattctgatattaatataaaagctagcacttatgtttgtgaaccgctatgttgcttgttccctgagcggttacaactctcgctatccggcggtataacattttccgttgacctaaaaaatatagaagagacgcttatcgccatggcagaaaagggtaatttatgtgactggaaggaacaggaaagaaaagccgccatctcctccaggattaatctgggcatcgcccaggcaggtgtaacagctattgacgacgctatcaaaaacaaaatagccgcaaaggttattgagaatactaacttaaagaatgcagcgtttgaaccaaattatgcacaaagctcagttactcaaattgtttattcatgtttgtttaagaatgagatactaatgaatatgctggaagaaagttcctctcatggcctgctatgtttaaacgagcttactgaatatgtagcgctacaagttcataacagccttttttctgaagatttatcttcactcgttgaaacaacaaaaaatgaggctcatcaccagagttgatcacaccataaatagtatggatttacaatcccctggcaataccaaaaccatctaatacaataactttaaatatatactcccagggaataatggatttactatggaacgaattggctcgttatttttataattgacatactgagtataagtatattttctcatacaacttatcgcacttattgacaaaccgttttcgctaatttgaagtgtggaataataactcaaagaaattattggcatcatagcctcacgacgtaactggaaggtggcatgatgcttacaaaaacgttatcagtagttttactgacctgtgcgctgttttcaggccagttactggcgaaacagcaagaccacgcattcgtatggtttgcgacgggagggcaccagcttagacacgaagccgacagcgatgaattacgggcggcagcggaagaatccgcggaaggcttgcgcgagcaccacaactggcagaaatcgcgcaaaccagaaagctattttcgttaattaaacgcccctgcgcttcggcagcgttttcatcagcgcttcagggctcactgaagcgacaacgctgccgggctggggcatttttaagatgtggtttttaattttgccaatgacatgcatttcgcaagggcggcagtcgaattttagcgtcagtacctcatcgccatgcaccaactgcatcggcgtggctttccagctcttaatatttcctttcgcctgctttggacaaaggttgaacgcaaaacgcaggcagtgtttggtgatcatgaccggtacctcgcccttctcctgatgcgcctcataggccgcatcaatcaattgtacgccgtaacggtgataaaattcccgcgctttgtggttgtagacattagcgagaaagctgagatgcgtttgcgggtagaccggcgcaggctgcgccacgggtttccgacgacctcgttgataatgggccagccgcgccgcgtcaagcatatcaatcgcctcccgacggaactgattgagcaggctatttggcacgaacaacgccgccggtaatgtcacctgcatatcacgcgcgtagtaaggcgtctgtcccagcttcgccagtccggcttttaggttattcaacgctttttcagagttgttggcttcctcaaataccccatcaagcgtatgcgtgatgcagacaccgtcttcactggtcagcgtcagaataagctgttcctgccagccgcccagcatgatatcaaccgccacacggcgctcactggaggtttttgtcagcgcttgctgccagttatgatccagattacgattcaacggatgatgcggacggactttatgcaggtcggcaggcatatcatttggccaaacgcggtagcggttatgaccggttttctccaccgtattggcgcgaaaacctaccacttcacgcttaatcaacacgttcagaccatcgccattcgccaacggctccgtagcttctacgtcgagataatccttcgccacattcagcacctcacctaccggcaagccaataaattttggtgaatcaaatgcgccaatatcacctttacgcgcgttaacaaaatagtcggtgctgccgcgatggaaggttttctccgtggagggaacaaaaaagtgttcggtccgaccaaccgacgcacgcgccagatcgccacgttgctcgataatcgcgtccagcatctgacgataatgcgcggtgatgtttttgacatagctcatgtctttatagcgcccttcaatcttgaaggaacgtacgcctgcatcgatcaacgcgccgaggttagccgtttggtcgttatctttcatcgatagcaaatgtttttcgtaagagaccacccgcccctgatcgtcttttaacgtatacggtaaacgacaggcctgcgaacagtcgccccgattggcgctgcgcccggtttgcgcatgagagatataacactgcccagaataagcgacacacagcgcgccatgaatgaagaactcaattgtggcgtcagtagcctgatgaatagccgctatctgactcaaattaagttcgcgcgccagtacaatctgtgaaaaaccgacatcggcaagaaacttcgctttttccacgctgcgaatatcacactgtgtactggcgtgaagctcaatcggcgggatatccagttccagaatgcccatatcctgcacaatcagcgcatccaccccggtgttgtacaaatcggtgattaaccgctgcgcgggctccagctcatcatcatgcagaatagtattcagcgtgacaaaaatcctggcgccgtaacggtgagcaaacggaaccagatcggcgatatcgcgcagactgttactggcgttatgacgtgcgccaaaaccgggtccgccgatgtagacggcatctgcgccatgcaaaatcgcttcgcgagcaattgcggcgtcacgggccggacttaacaattcgagatagtgaggttgctggcgcatacagtcgttcttatccaatagaagcgaaatggcggctattgtagtcagaagcgcaaactaacgaaatagttttcccgcttaatcacgtgggtaatggatcagcgagtgaaaatgaaccgtctggtcactgctgttgcgataggtatgcgccgtatcgccggcaaaacgcaaacctttaccggcgtctatggtttgccataccccaccagtacacatgtccagccgaccctgaatcaccaccacatgttcgataacgccggctttatgcggcgttgattcgctgaccgtgccaggcgccagcaatagggaaaaatagtcaaaacagagttcaggatcccatggaaacaacggtgtgattaccatcgcttgctgctggggatcgaaggtcggaggaaattcggcctgcggcggcgaaataaacactgagaatggaacgttcaggcccgtcgcaattttccacagcgttgcgactgtcggactggattcattacgctctatctgccccaacatggcttttgagacgccggagatctccgccagacgcgataaactccagcctcgctgatggcgtaacgttcttaacgtggtcgccagatagtgtgtcaggttatccattttcccccctgtaaggccatagcgtatcacttgtacgctataacgcacaatgctacattgactgaccgttataacgcacaagaggcgatcatgcgtctgttatcactgccgttacctactgtattatctggtctggtcgccgttctggtcggctatgcgagttccgccgccattatctggcaggcggcgcttgccgctggcgcaacacccgcagagatcgccggctggatgaccgccctcggtatagccatgggcataagcacactaacgttaaccttgtggtatcgtgcgccggttttaaccgcctggtcaacgcctggcgccgctctgttggtaacagggcttcagggattatcgttgccagacgccgtgggcatattcattgtcgccaatgccctgattgtgctgtgcggcgtcacgggattgtttgcgcgtttgatgcggataatcccccattctcttgccgccgcaatgctggcgggaatactgctacgcttcggcctgcaggcgttcgggacgctcaacggagagtttgtcatgtgcggcggtatgctattggcgtggctactctttaaagtattcgcgccccgctatgccgttattgctgccatggtaatgggaataacggtggcgctcatccagggtaaggtggcgatgagcggtattcatttcgcgccggtgtggcccaccttcgttcccccccacttttcattcgctcaaagcctgagcgtcgcggtaccgctcttcctggtgacgatggcatcgcaaaacgcccccggcgtcgccacaatgaaggcgtctggctatcagcttcctgtctctccgttaatgatttttaccgggttgctggcgctgctgctttcgccatttggcgtttattctatctgcattgccgccattacagccgccatttgtcaaagcccggacgcgcaccccgatccaacgcgtcgctggttagcggccgccgccgcaggcgttttttatttacttgccgggtggtttggcggttcgataaccgcgctgatggtcgccctgccggttagctgggtgcaaatgctggctggtctggcactgttaagtacgattagcggtagcctgtatcaggcgcttactcacgaaagtgagcgtgacgcggcagttatcgcatttctcgtcaccgccagcgggctaacgctgatgggcatcggatcggcattctgggggttgatcgctggcggaataggctacgcagtattaacgagaacgcgccgcccatcgttgtctggctgatggtggccgctaatctgccggggtttgcgccatcttgcgatggcgccgcagaattattttttattaacgtcaaacatagaggtatccgtcgccatatcatccacgacctgtttcaacgtctcaaacgccattggcgtactggaattgctcaggtctttaccttcaccctggcgtactaccttgacgaccggcttgttggtcgcggcatctatcagctcaccttcaaaatagaggtgggtatccatggtccggtggcccgtcgccatttgcgtgcccgccacaatcagcgctacagggatcacctcatagaattgcagcccttctttgctggtatccacgcccgtaatcgccccgcggaaaatcaaactgcgcggccctggcgtcgtgaccagcggtttgcgctgttcaattgctgattttactttagtgttcgtataagccagcagtttatcaagaacttgctgcccgacctgggtcgttggtttggggacgggatagtatgttatcggattgtaaacaatactgtcatagttagagtcattgaaatgtggatctacccagcgcaacaccggtttccccgtggcggaggtagtttcctgcaggtccgaataattttttaagaatccagaatacttatccggctgtgtgactttagacgcacagccggataacgccagcaagccagtaagcactgcaactttaaataaagtatgagtacgcatgaaacgatccctttagtcttcgcaatgatgcaaaggaaataatagcaaaacgaaatcattctggatgcactaaaaatggtaacgacagcacaatttgaacgcggcgcccgacaaaaaaatgccgaacgcagcgagacttacagaacttgcatcgctcaggccgtttttctcgccagcatcgtagcaaagcgcagtttgatacggttgccattttcgtccgtgcggtgaagctcgccgacatcttcgttgtatttcagcatgtcccatccttcgtaatagcggcgtaattcgccttctttaaaagcgaacgggaatcccaccgtacagggaaagtccggcgtatccattgccgcaacaatcaaattatacccgccgggttttgtgcagcgttgcatattggcaattaaaccgggaatggtttgcgcctcaagaaacatcataaccaccgtcgagagaataaaatcgtattcgccgtcaaaggtcaatgtattcagatcgacaaggtcggtttgcagattatccagcccttctgccgctttaatacgctcaaggttagccatactggccggatttttatcccacgcggtaacgtcataaccgttcgcggccagatacagactattacggccattgccacatcctaaatccagcgttcggcctggcgcgacaacctttgccgccgccagcacatccgaatgcgtgcgggttaaaccgtatttctcagtaaagtaattttcgtcacgaacggtcatttttttcctccgttttcaacagtgcagcgcgctcagtgcgaataagcaacgtcccctgcaccagcaatagaaatgtacgaaccagcaataaagcgataatagcgttagtgaaaataaacagcgggacggccagaatatggaaaagccctgattcactaccgtgaccaagatgtaaccccgtggtcgccagcgcggaaacgccgaacgaaaaactccagaaggaagcattaaacggttgtgataaataccagggcattaatcgcagcataaataaaagctgtaacagaccgtagccgaatagcattttcgccagcgtgtcgccctccccgccattgacgctcagccaggcgctacaggcgaccagcgcgggcgccagttggatacccagcgacgtacgcagcaccgccggtaattcgccgcagctacgcagtcgctgcaaaataaccggctccagacttaaccacgaaaagacgcctgcgcctaaaaacaccagtccggcatcattgtaaccgagcgctccacaggccatagcgctgataaaattattcgctaccgtgggcagataaagtcctggggttgtcgcttcttccggatgcgctccgcgccaaagtcccgccgtctgccaggcggcatacgccagttgtatgacgacccccacgctgaatagcgcaacggccaacgggcgataccagggaacgaaaccgatcgcgaccagcatcgtggtggcgggaaacaggctgacaaaactgctcattaccggatgtcgcacttcagccatcacgctatggggaaagcgcaccagacggctaaggaacgccagggtcaagagtgcccaaataatcatcgccaggatcaccatgatgtcgccgggccagtggcttattccccatatctggctggcataacgccaggcgaatcccataccgatagtgccaaggacgatgccaaaatagcccgcaggcagattgagcacgcgatcgctctgcttgtgattacgcattttgtttaatttataaagtatatttgaaatgcattttatggaatttctggttgtttcgccagtacctttgctacggttatcttaatcgttcacacggaatttccctatgaccaaatatcgactgagtgaagaacctcgtgcttttacttatcaggtagacggtgagaagaaaagcgtcttattacgacaagttattgccgtaacggattttaacgatgttaaagccggaacctccggcggctgggttgatgccggtaatgtgctgtcacaacagggggattgctggatttatgatgaaaacgcgatggcctttgcgggcacggaaattacgggtaacgcgcgtatcacgcagccgtgctcgctctacaataacgtgcgaataggcgataacgtctggattgatcgctctgatatcagcgatggcgcgcggataagtgacaacgtcaccattcagtcctcttccgtgcgcggagagtgtgcgatttatggcgatgcccgcgtgttaaaccagtcagaaattctcgccgttcagggactaacgcatgaacatgcgcagattttacaaatttacgatcgcgccaccgtgaaccattcgcggattgtccatcaggtacagctttatggcgacgccactatcactctcgcttttattgagcaccgggcggaggtctttgatttcgcgctcatcgaaggcaacaaagacaataatgtctggatctgtgactgcgccaaagtctatggccatgcgcgggttatcgccggcacagaggaagatgctatccctacccttcgctacagctcgcaggtagcggaacatgcgttaatcgaaggcaactgtgtgttaaaacatcatgtgctggtaggcggacatgctgagatacgcggaggcccgattttactggacgaccgcgtgctgattgaaggccaggcctgtatacagggcgaaattctgattgagcaccaggtcgagattagcggacgggcgacggttatagcctttgacggcaatactattcacctgcgcggcccaaaagtgatcaatggcgaggatcgtattacgcgtacccccttagtcggttccctttaatccgcatcaataatgcgggcatacatattaacgtcgtgatagtcgccgttaagatactccgcctgcttcatacagccctccagcgtaaaatggttgcgccgtgcgactgcgttactggcctgattatcaacgcggcatttaatgacgaagcgccgaatatcgccgcgccgggcataatgtgtcatcagcgcctgtaatgattgcgacattatcccttgtccctggaaggactcatccagccagtaaccgatataggcggctttgtttatcggttcgatggcattaaatgagagtacgcctgccatctcattctggcagaaaatcaggtacattttggcgtaaccacgctggtgcaacagtatattaccctgcacatgcttacgcgtttcctcctgcgacgtgacatattgcggccagtcgagcgactgttgtagccacgctttgtttttgagtaccagttggtgcagcgccggaacatgactttcatctgccgctcgcagttccagcgtcgtgctaacaggaataatttccaccatcgcgttgcccttcttcgttgttggtcgtgatcacataaatagcctggtttaccgataacccgcaggtgatatgagcgtttttattgtatcgccatcacattattttttattggccatatttagcgtatttccgcgtgacacatttcacacttatccaaccattctccgcctataaaacgctcaacgactgattgttttatcaccacggagacgccaatgaccttttctgtgcaggaaacgcttttttctttactgcggctaaacgggatttcaggacatgaaaacagtattgcaaacgttatgcagcacgcgtttgaacagcaggccaaagacgtctggcgggatcgcttaggcaatgtcgtcgcccgttatggcagcgataaacccgacgcgcttcgcctgatgatttttgcgcatatggatgaagtgggttttatggtacgcaagatcgaaccctccggttttttacgttttgaacgcgtaggcggcccggcgcaaattactatgcccggttcgattgtgacgcttgccggacgttcaggcgatatcatgggctgtatcggtattaaagcatatcacttcgcgaagggtgacgagcgcacccagccacccgcgctcgataaactctggattgatatcggcgcaaaagataaagcggatgccgaacgaatgggtattcaggtggggacgccagtaaccctttacaacccgccgcactgtctgggcaacgacctggtatgcagtaaggcgctggatgacaggctggggtgtacggcgctactgggcgtcgccgaggccctcgcctccacaccgcttgatatcgcggtattcctggtcgcgtcggtacaggaagagttcaatattcgcggcattattcccgttttacgacgcgtgcgccccgacctggcgattggtattgatatcaccccctcctgcgacacgcctgacctgcaggattactcagatgtgcgggtcaaccacggcgtcggcatcacctgtctgaactatcacggacgcggtacgttggcgggactgattacgccgccgcgtttgctgcggatgctggagaccaccgcgcacgaaaataatattcccgtacagcgtgaagtcgcgccaggcgtcatcaccgaaaccggctacattcaggttgaactggacggtattccctgcgccagtctttctattccctgccgctatacccactcgccagccgaagtcgccagcctgcgcgacctggctgattgtatccgtttactgactgcgctggccaacatgtcgccagaacagtttcccattgagcctgaaacaggcgctacacaagaggcacgaccatgatgaaaaagatccttgtggcatgtggtaccggcatgtcgacatcaaccatgattgcacaaaaactgcaggactttcttgcggagcaaggcattgcggcaaccacggcgcaatgttgtctgaatgagatcccgttgaactgtaacggtatggatctcatcgtaacgtccatgcgtacgcacagtgactatggcatcccgacgctcaacggcgccgccctgctgacaggcatcaacgacgacgcattaaaacaagaaatcaaggcgctgttaacacaataaagggggcattatgtttgattacatcctgtctctcggcggcaccgtttttgtgcccatcattatgattatcatcggcttaatctttcgtattccctggctgcaggcagtgaaagccggggtgacggtcggcatcggttttgtcggcatggggttggtgatcgtcatggcgatcgacagtctcagtccgccgattaaagtgatgattgagcgttttggcctgacgctgcatgtgtttgacgtcggcgccgggcccgcatccggcgtcggctatgcgacggccatcggcgcgatgatcattcccgttatctttctgctcaacgtcggtatgctggtgactcgtctgaccaaaaccatgaacgttgatatttataactactggcactacgccattaccggaacggtcgtccagttgatgaccggcagtctgatttatggcgtactgggcgcgatttgccacgccgccttgtcgttgaaaatggccgactggacggcgaaacgggtacagaacattgtgggtctggaagggatttctattccgcaagggtatggctccagttccgtgccgttgttcgtattgctggatgcgatatacgaaaaaataccgtttatgaaaggacgcaatattgatgctcaggagatccaaaaacggtatgggatggttggcgacccggtgatcattggcgttgttctcgggctgatcttcggacttgccgcaggcgaaggctttaaagggtgcgcaaccttaatgattaccgtggcggcgattatggtgctgtttccgcgcatgattcgccttatcgttgagggattaatgcccatttccgacggcgcgcgtaagttcttccagaaacactttaaagggcgcgaagtctttatcggtctggataccgcagtgacgttaggccacccgaccaccatcgcggttggactgctgttaattcccatcatgttaattctggcgagcatactgccgggcaataaagtcctgccgctggctgatttaccggttgcgccgttttttatctgcatggccacggttattcatcgcggcgatctgattcgtactctgctcagcggcatcattgtcatgattaccgttctgctgatcgccacccagttcgcaccgtactttaccgatatggcgctcaaaggcggctttagcttcgccgctgaaaacgcgcaaattaccgcgctgtcggtgggaaatatgtttggctggtcaatatctgaattgatgtcgctgggcatgattggcgtggttattgtggtcggcattgtcgccagcatcatacttgtcttacgtaaacgtgaactaccggaataaggagcaacccagaatgagttggctaaaagaggtaataggaacagaaaaagccgttatcgccatgtgccatttacgggcgttgccgggcgatcccgggttcgataccaggaaaggcatgaactgggtaattgaccgcgcccatgacgatttaatggcgctacaaaatggcggcgtggatgcggtgatgttctccaacgaatttagtctgccttatttaacgaaagtcagaccggaaacgaccgccgcgatggcaagaatcatcggtcagttaatgagtgaaatccgcgtaccgtttggggtaaacgtgttgtgggaccctgtggcctcgtttgatttggcgatggcgaccgacgcaaaatttatccgcgaaattttcaccggcgcttacgccagcgattttggcgtctgggatacgaatgtcggcgaaaccattcgccatcagcatcgcatcggcgcaggccacgtgaaaacgttgtttaacatcgttccggaagcggcggtgtatctgggaaaccgcgatgtctgttcaattgcgaaatcgaccgtatttaacaataaccccgatgccctgtgcgtctcggggctgacggcgggcgctcgcacggatagcgccatactgaagcgagtaaaagagaccgtccccgacacggtcgtgctggcgaataccggggtgtgtctggaaaacgtcgaggagcagctctgcattgccgacggatgcgtaacggcaaccacgtttaaaaaagacggcgtcttcgccaactttgtcgaccaggcgcgcgtggcgaagtttatggagaaagtacgccatatccgacaataaaatggggataagcaaaacgcttatcccctgcagagagcgataactcttctgccgatctccgtcgccttcgccaaaagacacgccggggatcggttccagagtaacccgaaccggcaaggagtcaacgatcgatgattaatgatgttaagtgggttcaggcgcaacgccatgccagcgactggcgacacgcgctggatatcgccgttcgtccgctgattacgttcggcgcggcggccccctgctacctggacggtattattgagaacacccttaaatgggggccatattatcttatcgcgccggggattgcgctgccccatgccagaccagagcaaggcgccaaccataatcaaatcagcgtcactacgctatcaacgccggtcgctttcggcaatgcggattgcgatcccatctggctgttgctttgcgccagcgccacggatgccgaagcacatattcgcaccattcaacgcatcagccagtggctcgactcgccggaaagcgtcgcgatgttgcaagatgcgccaaatgatgccgcgcttttcgcgcaattaaccgcattgcgctgatggaggttccgatgatcctgcacccttcactggcctccgccgatccgctgcgctatgccgaggcgttgaccgctttacacgatgcgcctctcggctcgctgcatctggatatcgaagataccagtttcatcaataatattaccttcggtatgaaaaccattcaggcggtcgcacaatacactcgccatccgctctcatttcacctgatggtctcatcgccgcaacgctggttaccctggcttgcagctatccgccccggctggattttcattcatgccgaaagcgtgcaaaaccccccggagattctggcggatattcgcgctatcggggcgaaagcaggactggcgcttaacccggcaacgccgctattgccttatcgttatctggcattgcaactggatgcgctgatgatcatgaccagcgaacccgacggacgcggacagcaatttatcgccgcgatgtgtgaaaaagtgagccagggcagagagcatttccctgctgcggaatgctgggcggacggcggtattacacttcgcgccgcacggctgcttgccgccgcaggcgcacagcatctggtgattggccgggcgttattcacgacggcgaactatgatgtgacgttgtcacaattcaccgcgctataaaggagtcatatgctgatgagccaacagcgccccgaccgtatcaaacagatgttgcattacctttggcaacacaggcacctctcaacacagcaagctattgagctttttggctatgcagaggcaaccgtgcgccgggattttcactatattgccagccgttatcccggtatggttcgcggccatggttgtattgacttcgacgacagtacggaagataaagaatatgttttcgacgttaagcgaacgttacaaagcgaggcgaaacgcgaaatcgccgccctcgcccgcacgttcatcaaggatggagactgcttttttctcgactccggctccacctgtctggaactggcaaaatgtctggtcgacgccaaagtaaaagtcatttgcaatgacatcaaaatcgctaatgaactgggtggcttcccacacgtagagagttacattatcggcggactgattcgccccggttacttttcggtgggcgagagtctggcgctggagatgattaacgcctttgccgttgaacgcgcctttatctcctgcgatgcgctgtcgattgaaacgggcatcaccaacgctaccatgtttgaagtgggcgttaaaacgcgcattattcagcgctcacgcgaggtcatattgatggccgatcactcaaagtttgatactgtagaaccccatgcggtggcgacgctgtcctgtattactaccattcttagcgacagtgcgctcccgtctgctatcgcccgacgttatcagcaggcgggatgccgtctcatcatgtcagacccctcatcaggagcgcgttaatggacatcaggcaaatgaacagaacccatctggatcactggcgcggattgcgaaaacagctctggcctggtcacccggatgacgcccatctggcggacggcgaagaaattctgcaagccgatcatctggcatcatttattgcgatggcagacggggtggcgattggctttgcggatgcctcaatccgccacgattatgtcaatggctgtgacagttcgcccgtggttttccttgaaggtatttttgttctcccctcattccgtcaacgcggcgtagcgaaacaattgattgcagcggtgcaacgatggggaacgaataaagggtgtcgggaaatggcctccgatacctcgccggaaaatacaatttcccagaaagttcatcaggcgttaggatttgaggaaacagagcgcgtcattttctaccgaaagcgttgttgagggaaatcatacaggaaaaggtcgggtatagtacccgacctttatattactggggcagatctttttcagttaacaagcgtgtcgttttcacttgttcaatatttctggcgccacccaacatcatgttaattgtcagctctttgtttagctgttcaatcactgatgccacaccctgagcgccgccaagattaagaccgtataatacaggccggccaaccgccacaatatccgccccgctggctaacgctttgaatatgtgcgaaccacggcgtactccactgtcaaaaataacaggcactcgcttgttgacgacttttgcaatcgcaggaagcatatcgaatgaggacggcccgctgtctaattgacggccaccatggttagaaacccatattcctgcggccccggcctggatagcaatttcagcatcctccggcgactgaatgccttttacgataaccggcagaccggaaatacgatgtacataggcaatatcctccggcgtaaaggcttgtttagcctgcgcgtaaatttcacttatccctgctcctttgccagtttttgaaccatcgtcattttttctggcgaacatttccaggtttgcaaagcccaacgggaactggaagttatttttaatatcttcttcccgataaccaccgacaggcgaatctacggtcagaataatcgctttagcgccatgctttaccgcttgtgcaagaataaattcgttaaattgattattcttactcatataaagctggaagaagaacggatttttcccggaaacgttagccacctcttcgatggtcttgttgccataggtgctcaacgagaaaatcgaaccgacctgcgccatgcctttcgccgtcgccaactctccggaggcgtgggccaggccctgcgccgccatcggtgcctggattataggcgttttaagcggaatacccagtagctgcgttgataaatcgatctcttttaactcaatgccctgtaatacgcgcggcataatatattttttgtcaaagctttcggtgttgctgcgaaggttattctcatcttcggctccaccgcgaatataaccaaatgcccctttctccattttggcctgaacgcgcgcttccagggaggctacgttcgtcatttttattgctttttcgtccgtactggctttgtactcttcagcataagccaggcctgatgttgccaacattgccagcgaggccactacccgaatgaggtgatgagttttcatcattattccctttattgcttaaccgcttctgcctggatttttatatcgacaactttcgtcatccccatatcgaccagataatctatcccccactgggtgcgatctatttgcgtgacaaaatcaccaccgcaaacctgcgccttgaatatcgggctcatataacagccaaacttggtggtggttaaggtgacgggcttcgttactcccttcattgttagcaaaccgtcaatagaaaccggtttattatcttcaaaatgccattttgttgatttaaataccatttctggatatttttccgcatccagaatatcgctactgcggatatggttatcaaacgcatccaccccggtatttaaggcgcttacgggaatcgtcacacgcatctctgcgacttgcttttccggctgatatttcagttcgccgctaatagcataaaacccgccatgattggttgaggtctggaaatgatcgatattaaataccgcattggtatgcgtattatcaaatttatatacatctgcatgagcagcacttaataaacccagagacaggagagcaccaagaaaactctttttcattatattcactttatatcttaaataaggtgaagctatcttaatgtcccctgtacgcaggatcgagagggataaacaggaaggactgttgcaaaaatagaacgatgaaaaggccgtgtcacaaaaacagcagctcacgaatgagtttatgtcagggctatttccgcaacctgtaccgcctttgtggcggtacagaaggcaaactgactaacgcatgatacgatcgtcgacataacggcgcttatccggcgcgggcgggaaatactgatacagccaggtttcgctgatagcctccccctggcagcgcaggaacatacgcatatccaccggtgccgtagaatccgaggtcggataccagtcaaactggatacgataaccgtcgaaaggctcaacgtagaggatctcaatctgcttcgcctcaccgctggagagcgtaattaccggctcaatgccttttggcgcggccgctttcagatcgccgccgacaaaatcaatagcaaaacggcgcgcccatttatccgggtaatgttcgcccggcgcccaaccttcgggaaagccgcccatccctgtacgggtcgccatgacccgcgcaagcggcgattgtaccggcggctgcgcgctccagtacaaacgataattgaacgccagcgtatccccggctttgatcgctttttccggctgccagaaacagaccacattatccagagtttcgccagtggttgggatctccatcaggctaaccgcgcctttcccccacttattgcgcggctccacccacaggctcggacgtttgttgtaccaccccatcacatcctgataatgcgagaaatcgcgatcgagttgcagcaggccgaaccctttcgggttatcgtccatatatgcattgaactgcaatttctgcggattattcagcgggcggcaaatccactcgccgttaccccgccacatcgccagccgatcggaatcgtgaatttgtggatgaatggtgtcgcatacccggcgttcattattcccacagctaaacatactggtcatcggcgcaatgccaagttgcttaatatctttacgggcgtagagatggttttctacatccatgatcacctgcgatttttcgcaatgaatcacaaatttatacgcgcccgtcacgctggcgctgtccagcagagcgtaaacggtaaacgtagtatcgcccggcttcgcggtgtcaaaccagaatgcggtgaagtcagggaactcttcctgaccgtcagtataggtatctatcgccagcccgcgagccgacaggccatactgataagtatcatctaccgcccggaaataactggcgcccaggaaggagacgacatcgcgccgcgccagttccggcgctttaaagacacggaaaccggcgaaaccgagatcgctctgcccttccagttgcgtcgtatcgacgccggcatcgttgtatttaaacagttccgggcgaaaatgaatctcgcgagcaagatgcgtcgtcgtatcaacggaaaacatgcgtacgcgacgacgaaagcccatccctacgtggaaaaactgaatatcgagctgccggttggcaacaccgttccagagtgaatgcgccgcgtcatactgaatgctgttataggcctgcggcgtcagattggcgagcgtatccggcaagggtcccggcgcgccaccccagggctttttcgctaacgcctgggccattgattgcagaccagcaaaatcaaaacggacaattttaccatccgcaatatcggattccgcggcaaacgccgcctgagaaaagagggaagcaataccgctggaaccgcacacggcggccattgccattgaacctttaataaatcgtctacgattcatacctgaaaatgagtccttctggtcttgtgaatggtcccgcgctggttttttcagcagcaagaatgtgcccgtttctgaccgctcactctagacaaaattcattaataatccaattgttggtcgcctggaaactgtgcaaaagcgtaaatattttatgtcgataagaaccgaccgaatcggatgtaaacctcacgcagcattcttcaggttatgaaaagtttattccagactaacgtgatgtttcatgactcgtttaaacagcgccagacgcgcacgcataaagcggttttccactttaaaaccggcaagtttgttcagcccaatccgcaacagacgatctcgcccccgaatgctggcgggccagcgaaccgggccgtgcagcacgtcgcgcgtgcggctggcatgacgagcgaaattcacccagtaatccgccacctgcgaggcaaaggccaggtcattctcattcacataatggcatgtgggctcagcccgcgttaacgtatcgaatacatacggtatttcattgccatgacaggcaccattcgcgtaggtgttatgctccgcttcggcgacataatcaaaccagtaacgccagcacggttcgccgatccgctgctgcgcttgcatgacgacataacccaacgtggtaaataccatatcccgacagacctgccgccctagcgcttcgtcgcctttcactccaggataaagcagccggattaaccccaggccaacacgccgctcacggcgcattttttgaatttgaccggcaatatcgacgccaaaaacggccaatacgctggcttcatcgctattcgagccgatcatcaccggtatcggatgctgtttcgccgcaaagaaggtttccagcatcggatgcggcagcacgacgtcgccggaaatcggcgtcggcgcaattttaaaaggcgcgtccagcggccaaaacgtctctgccggtaaagcgcgtagctgttcggcagtggcatgggctaaaccaagatgttccgccagcgcaacgcctttttttagcgccacctcgcggggcgtatccggcagcgtataaccactctgaataatcgctttatgaaaaagccccttcgccaacggcgaagccatcaacgacagcacgctgcgggcgccggcggattcgccaaataacgtcacattctgcgtatcgccgccaaacgcggcaatattgtcctgcacccagcgcagcgcagcgatttgatcgagtaaagcaaaattatgaatacactccgcctcttcgccttccagcgccggatgcgcgaaaaagcccagatggccaagccgataattgaccgtcaccacgatcgcgccgcgcttcgccagcgcttgaccgtcatagggcggcaaactccccgcgccaatggtataaccgccgccgtgtagccagaccatgaccggcaacggttcatgacgcacggcgggagcccagacgttcagatagagacagtcttcggaaaaatttcccggatcgccgccgccgagttcgcgacaccaggtaatatcctgccaactggcgcaggagaaacaatccgcctggcgcacgtcgtgccagggcgtaacaggctgcggcgcacgccagcgtagctcccctgttggcggcgcggcataaggtataccgcgccagatatggatttcttcctgtacgacgcccacgattttaccgtgacgcgtctccaccaacgggatggagggattcaacataacgccttccttttacagtatcctcacagcctgtgaagcttaccgcttttaaagcagaccgcaacggcgtttactgcgttcttccgcttcctgatataacgaaaattcatcccgtactgcacatcccagcgcctgttcaaaggcgtcgcggctggcattgccgtggcttctggccagcgtttcatctcccaaattcgactgaaaaatgccggctgcgctgaccggaagaaaatcttcataggtaatcggctgcgcgattacccaaccgcgctcaataagcggctgcggatcgtcgccaggatggatcgcctgacgatgcgcctcgccggaaggcgttaagcgatagcggaaccaggcaagcccctgctggcgaagcagaaattcgctatccggaaaggcgttaaagacctcccgcaaatggagttgatgcgtgaagttatccttacccgttcccgccttgtgcaacagttcgtcatataatcgacgaccttttggcgtcagcgcgacgccacgttgctcaatttcgccgaagcgcgccgtgtgcgtaccctgcttttcatcaacgaagagcacctgctcttccagagctttgaaactggtttgccgcaacagaataggcacttcgcggcgaggcggaccttcgataagaattttaggcgtaatgccgcactccggcatcatggcctgtacccggtcgatatccagagtacgcggcgtcagatggttaatgtggcatcccggaaaacagaccacgtcggcaattaaacgatgctcacgatgcaggctgcggtacgtttcttcatcaacggtagcctgacgatgccagcgaaaagtctccagcgtttcacggacgaactcttcggcctgagcagcgctaaaaccgccctgctcgtcgtactcatccagcaattgtcggcagcgcgatgtaaaaatatcacgctgcgataagatttccgccgcccgctggcgtaatgccgcgttttcaatgagctccaggcgtaatagcgaagtgaacatgcgaaagggattacgcgagagcgaagcctcgtcaatgggacgaaatgccgtggagtgcacaggcacgcccgcctgagagagatcgtaataacttactgggtacatccccatgatggcgaatatccgacgcaaggtagaaagttcttctgcggtgccaacacgaatggcgccatgtcgttccacgttcaatcgcgccagttcatcggcattagccaactgctcatgcagtttgggattattttccagcaccgccagattcacgtcagccacaagttccagtaacgtaccgtactgcggaacttcctgctggtacattgccgacattgcctgcgaaaagtgttcccgaatctcatctgccgtgatggtgttcgccataatgtcatgcctccagtgaatgttacctggagtgtagaaaacctcatccattccggggagaagaatttataaagtgtgatccgacctgaattcattatgcagaacggattgacatgagctggcatatccccgaccagatcgcggcttaacacgcttaacggcagttgaatcatcagtaaaataaaacagttgtaacttgaaatggtaaaatgttaataatattttgctatcaggttatcaaaaacaaacaactttacttgtcacccgcacggctctgtttttaacatcgcttatggaaaaaaatggtctgtttagtcagcgcattcggttgcgccaccttcatacatttgtcgccgttgcgcaacagggaactctggggcgcgcggctgaaactcttaacctgagccagccagcgctttctaaaacgctgaacgaactggaacaactcaccggaacccgtctgtttgaacgcgggcgactgggcgcgcaattaacggttcctggcgaacaatttttgactcatgcggtaaaagtattagatgcattgaataccgccgggcaggcgctgaatcgcaaagaggacgctagcgccgatgtggtgcgtgttggcgcgctccccaccgctgcgctgggtatactcccggcggctattgggcggttccatcaacagcaaaaatcgacctcgttacaggtcgcgaccatgaacaatacgatgttgcttgcgggtcttaaatcaggcgagatcgatctgggtattggccgcatgtcagacccggaattaatgggcggtttaaattacgaactgctgtttttagaatcgcttaaattagtggtacgccccggtcatcccctgttacaggagacgatcacgctcagccgggttatggaatggccggtagtcgtctcgccaaaaggcacggtaccgcgccagaatgcggaagccctgttgcaaagccaggggtgtaaaatgcctgccggatgtatcgaaacgctatccgcatcgttatcacgacaactgaccgtagattacgattacgtctggttcgtcccctctggcgcggttaaagaagatcttcgccaggcgacgctggtctcattacccgtgccgacccagagcgcgggcgagccgataggtattcttacgcgagttgatatcccgctctcaaccggggcgcaaatgctgattgcggcgatccgtaaatcgatgccgctgtgatagcggctgtcggagaataaacgcgcccgcggctaaaatagcccgctggcgcgacgcttactaaaggaaggatgatcgcatcgtcgcgccagtatcatgtaaacgaaacgcatcaacggcttgcgtcaagcgggcagcctgttcttcaagcgaagctgccgccgcggacgcctcttcgaccagcgacgcgttttgttgcgtaaccctgtccatctcagaaatagcctgactgacctgaacaataccgcgactttgctcatcagaggctgccgcgatgtcgagcataatatcggtgacgcgtttgacggcatccacaatctcattcatggtgctccccgcagcgataacctcttcagatccttgttcaatcaggctgaccgatgcgccgatcaagccttcaatctcttttgccgcctgcgcgctgcgactggcgagggtacgaacctcactggcgaccaccgcaaaaccgcgtccttgttccccggcgcgtgccgcctcgaccgccgcgttcagcgccaggatgttggtctggaaagcgatactgttaatgacggcggtaatttccgagatttttttcgagctggtggaaatattccccatcgtttgtacgaccccggaaaccatctggcctccgcggctggctttaccggaagcatcttccgccagtttgctggcgtgatgcgcattatccgcattctgcttaacggttgccgtcaactgttccatactggccgcggtctgttcaatggcggcagcctgctgttcagtacgagaagataaatccgtattaccagcggtaatttcgctggtgcctcgataaatttcctccgccccctgacgcaccgcccctaccgtttgttgcaacgcatgctgcatctgctgaagatgatggctcaggcgaccaatttcactgcgtcctgtgggctcgtcagccatggtcagatcgccggccgcaatgcgttcgatacgtgacgcagactgctgcaagggttgtatcaccgtgcgacgcagcaccatgaaggtcattaacgtcaataccagcgccaacgtaaatgcgccaatcataaacatcataccgagccgggtacgttggtaagcctgctcgctaagtagtctcgcccgctcggtgcgcagttcaatcgctttcaacaggacatggttatatgcggcatccagttgttttgcctgctcgttttcatgattaatgatcgcttcgaacatgccatttttggcaaatttcagcatcggttgcaggccgttgatataggcggtgtagcgggcgtttaactcgttatctaacgcgtcatcggcgggtgttttcaccgctctggacatataagcgttaaagccgtcctgagactgcttgatccgcgtttccgcagcggcaatattggctttcatttcatccatttcagcaatccggctcgccgcgccagcgtggatcatattgatacgtgcggtacgtaagtggttagcgctgttggataatcccatccgtacctgaatctcgtccgtgacatcacgctgatcgcgatcggcctgtaacagaaaatagcctgccagcccggcgctcaaagcaaaaagaagaaggatgccaccgagaatggaggaaaacagcggaaccagccgaatatgatgcaggaagcccagtttatgcgaggcttgcatcgagaatgtgttgcccatgaccgtcgactctcttgtaggttttatgcgtaaaacacgcccgttagatagtcatcggcacttcgtgacgtttgcttatcgcgaaaagcatcgccttcgtcacattttcacaacattcattccagaaaattcagaaaagcgccagcggaaaatccgctggcggatgaatcagttatcgccaaagtggataacagtacggatggatttaccctgatgcatcagttcaaaggcatcgttaatctgctccagcggcaggcggtgagtaataaaaggatctaaacggattttaccgttcatcgcatcttcgaccatccctggcagctgcgtgcgccctttcacgccgccaaaggcggagccacgccagacgcgaccggtcactagctggaagggacgggttttgatttcctgccctgcccccgctacgccaataataatgctttcgccccagcctttatgacaacattccagcgctgctcgcatcacgttaacgttgccgatacattcaaaactgaaatctacgccgccatcagtaagctcaacaataacgtcctggatcggtttgtcgtaatcattcggattaataaagtccgtggcccccatttcgcccgccagcgtaaatttttccggattcgtgtcgacagctaaaatacgcccggctttagcctgaaccgcgccctgaataaccgccagcccaataccgcctaaaccaaaaacggcaacggtgtcgcccgctttcactttagcggtgttatggacggcgccaataccagtcgtcacgccacagcccaacagacacactttatccagcggcgcctgcgggttcactttcgccagagaaatttccgcgcaaacggtatattcgctgaacgtgctggttcccatatagtgataaacgggttcgccgttataagaaaagcgggtagtgccatccggcatcagcccttttccctgagtggcgcgtacggcctgacaaaggttagttttaccggacttacagaacttacactcgccgcattccgccgtatacagtggaataacatgatcgccgggtttcaggctggtgaccccctcgccgacctcgactaccacgccgccgccttcgtgacccaggactgccgggaatacgccttccggatcatcgccggaaagggtaaaagcatcggtatggcaaacgccggtatgagtgattttgaccagaacttcgccttttttcggcggcgcaacgtcaatctcgacaatttttaacggctgaccgggaccaaaagcaactgctgcacgtgatttcatatatctcttcctgttacggtgagggaaattgttattttagataagcgcgaagaagatggccgatttccgccatccgaaccgcgcgctgatctggcgtagtctccccgctgaccagctcatctttcagatggatttcaaccatttcactcatcaggccattagacgcgccgcgcacggcggcaatctgttgcagaatcgccagacaaggttcgccagactcaagcgcccgctccagcgcttcgacctgcccgcgtatgcgacgaacacgggtaaggatacgttttttatcttcaggtgaatgcggcattcgacctccatatactataggggggtatactatcagaattttatgtttatgtaattgtaaaattacgcacaatataaaaatcaatagcttatagatttccggcatagaccatcaagaatcagttcacattcagcatattcagctcatgggaactttttcaggccacagacaataaacaccaaagctttctttctaagctgcaatgttctgcccgactggggcacagaggtaatgccggtaaatccagtcccattacccagaagtaaatatttgcttaatagtttttatttactcaccaggtggtaatgaataaaggttatgatatgcagatgtcagtcttgtaagaacgtaacatcacaactgcgatacaccgccgacgggtagcgaaaatatctcaaccctgtgtctttccaggcttagtcaatgtggacaaaaaatcaaatgagcgttatttgaaagatttttaatacccaaaagcgtcatcattattgttaatttgaaatcaatctcaggtaataatccatgcctatttcgatttgtaaacatggtgctccttttgttgttcaacatgaaaatcggtacggttccggtgcaagtcagtcatcatcactttcaaaatcaatccgccatattagcaactctcatgaggaaataaaatttataagttgctatagtgcaaatggagcctgtttttccaatgcacagatgctagccaatgcctcagggaggcctgttataggttactatgggaaaataaataagttaacagccagtctggataatagcggtcgtatattccgcccacagcataagcttgcggccaatatttgttatgtaggtaatcggcttctgagcgctccagttcaacttgggtttggcctgaaacatctgctaacctgtcactcaaatggtaatgtcagataaagtgtcatgccatgtccttcccggcattgctattccacagcctacagatatgggcgctcagttctttcctcaatcgttgctatgggaagttctgccgtcatttcacgctcttgccaaccagcattttattaaagcctgacttttaccagagtaatttcataagagtgcccatcttctggtctaaaaataataaatctattgttatttttagtaaaggatttcgacaaaataaaactatcatgatatctggccaggacgtagtaccagcctccatcatacaatatcatttcgtattctttctttaattgtggtttatagatcccaacaaaaaaagaaaatataaaaaaatatataataaaaccaagcataactatagtgaaacaatgccttcgcacccaactgagttgcgtaaaacaaatcactggcatcaatttactataaaaacgcatccccaccgataagcataaagctaccagtaaaatgataaaaaaaagctcccacaaaaacgattctgttaagagagaaaactcgataacaattggaataaagaacaaaaccgctgccaaaaaaagacgtaaaaagctaatgtcgtggatacgtgctttttgctttactagaaaaaataatagaatacccactccccacgctattatgaatatagccatcaggctaatcgcatggaatagacttcgggcaatgttgtcagggccgacgcctacataccaccacgggaaaccatagtacgcggagacgccccagccataaaaataggcgcttccccatcccaaaccacctaaataggccaaaagcatcgaagagtttttaataattgaatcatcattcattatagttaactcacttaagaaatatttaatatgaaaatagaaatcaaaatgtcacataaaacactagcactttagcaataatagtcggatgataagtttgtctgtttttcctgagtatcaagccagctcatactcacgccagcacactaaaatcaggagtggcttcttttttagatctttgccttagccaggcgcacactcaataatgatagcagtcagataatatgtaccaggcattaacctcacgttgttgatgatatatttacttcgttgaaaaacaataaacattgtatgtattttattggcgacgaaaaactgttaaagaagcgtaattccatatacaccatttacctgattacttttcttgctaatatttgctaattaattatttgctaaagcgtgtttaataaagtaaggaggacactatgccattgagtgttggacagggttatttcacatcatctatcagttctgaaaaatttaatgcgataaaagaaagcgcacgccttccggaattaagtttatgggagaaaatcaaagcatatttctttaccacccaccatgcagaggcgctcgaatgtatctttaatctttaccaccatcaggaactgaatctaacaccggtacaggttcgcggagcctacatcaaacttcgagccttagcgtctcagggatgtaaagaacagtttattatagaatcacaggaacacgccgataagttgattattaaagatgataatggtgaaaatattttgtctattgaggttgaatgtcatccggaagcttttggtcttgcaaaagaaatcaataaatcacatcccaagcccaaaaatatttctttgggtgatattaccagactggtattttttggcgacagcttgtctgactccttagggcgtatgtttgaaaaaacacatcatatcttaccctcctatggtcaatactttggcggaaggtttactaatggatttacctggactgagtttttatcatctccacacttcttaggtaaagagatgcttaattttgctgaagggggaagtacatcggcaagctattcctgctttaattgcatcggtgactttgtatcaaatacggacagacaagtcgcatcttacaccccttctcaccaggacctggcgatatttttattgggggctaatgactatatgacactacacaaagataatgtaataatggtcgttgagcaacaaattgatgatattgaaaaaataatttccggtggagttaataatgttctggtcatggggattcccgatttgtctttaacaccttatggcaaacattctgatgaaaaaagaaagcttaaggatgaaagcatcgctcacaatgccctgttaaaaactaatgttgaagaattaaaagaaaaatacccccagcataaaatatgctattacgagactgccgatgcatttaaggtgataatggaggcggccagtaatattggttatgatacggaaaacccttatactcaccacggctatgtacatgttcccggggctaaagaccctcagctagatatatgtccgcaatacgtcttcaacgaccttgtccatccaacccaggaagtccatcattgttttgccataatgttagaaagttttatagctcatcattattccactgaataaagttccatcggctgcggtacgccttgagcaaaacacagctcaatatcatagtgccggtggcatgaaaatatgatgctatctttgctgccgattggtcaataagtgatacatagtctatgttcagtaagacaaaaatggatagagtcgataaatcgccaccgtaactaaaatactcactatcacactgacaataaagtatgttttgaatggctgcttttgcgttttatgacggaagagttgttgaccaacaatcgccccaggccacccaccgacaaccccaaacaccaacaaagtggattccggcactctgcgccaggttttacgtgccgccgttttgtctataccgtagatcgccagcgttagcacattggcgagcaggaaccacatcgcgacgggatgcgatgtaaaaatgcttccgaccgcagcgaagatcaggagtaaataacaaaagcggttaagatacatatcattatgtcatagcaataattaggggcatcggagcccattatacgcgatacatgcgcctatgtgatgtagaatttttttcactcagccaacgagtcattaaggattcatttttaattaccatggtaatcataaggtaattaacggctgtgaacacgattaaaatgggtaaagccaccgaaaatgttaccaccttaaccgttgccaggataacttaatgaagaaccctctttattgctgtttgttatccggttggcagtctcagttttggatttattaatcgtatttatatttattacataagatgtacgatgttaatttgagaattttatctcaacaaccgtatatattcagatatttctgaattaagattatcatcgattaaaacaagttaacgttttgataaacataacaacatcgtcagaaatcatgatttgttgtcgtttgttcatgagacaaataatttatatgcttgcaaatatagatagcacgcaaatcaacttagctcaaaaaatgtatttgacaagaaaagataagtctttatattggccctggatagagtggtaagatgataattagagacatgaaaggcaccgtcactgaagcatttatctgcttatcatgtaaatatgtatgcgtaaatggagcataaactatgtccagtatactaatgtctatggtatctttacattttcacctttcatggtgtcgctgcactcatatccagttgatatcttatggtatattcaatccattccctttgatgattcctgtcaaacctcctgattaaattagttaacagcgatggaatacataacgttaagtactttacgcctgcaaatgtcaggctcacgccctaatgcttaatttataatacgcattaccttactacaggaaatagatagcatgttatccaaaaaatttggcttatcgatgatagtgttgggaataatgtcgtcttcagcgtttgctgatagcatcgttgaagggagaacactcaatgtcgcagtatcaccagcctctccccctatgttatttaaaagtgctgatggcaaattgcaggggatagatctggagcttttttcgtcttactgtcagtcacggcattgtaagctaaacatcaccgaatatgcctgggatggaatgcttggcgcagtggcgagtggtcaggcagatgtagcattttcgggaatttcaatcacagataaacgtaagaaagttattgatttctctgaaccttattacatcaactctttttatctggtcagtatggccaatcataaaataacgctcaataacctcaatgaattaaataaatattctattggataccctcgaggaatggcttactccgaccttatcaaaaacgatctggagcccaaaggatactactcgttaagtaaagtaaaattgtatccaacctataatgagacgatggctgatctaaaaaatggcaatcttgatctggcttttatagaagagccggtttattttaccttcaaaaataagaaaaagatgccgatagaaagccgttatgttttcaagaatgttgatcagcttggcattgcctttaagaaaggctctcccgtgcgcgatgatttcaacttatggcttaaagagcaagggccacaaaaaatatctggcattgtcgatagctggatgaaatagtaagctatgtcatcaggtaatatgctggctatcttttatttcctattggaagggattggtaatacgctgcttgtaacatttacctgttttctctcagcgtttttgaccgggcttacagtcgccgtattacggcgactatcccctcttccactacagaagatactcgacgtactggtctttattcttcggggaattccaatacttattgctgtttttcttgtttattttggattgccatcgattggcatatatgtttcaccactggtggccatgaacctcagcgtcggcttaatcagcgggagttatcttgccgaggtgttcagaggggcgcttaaattagttgagccattcgaaataacggtagcgaaagtggcaggaatgcgtcaattacaggttataataaatattgaactgccacagatgttgcgattttctgtgcccggtattatcaatgagttttcttctgtattaaaagcgacgccctttgcttatactgtaggcatcgctgaaataacgaagcaggcaatgtcactgacagccatcacgctgaacgggttacagatttatactcttgccggggtattatatttcattatttataaagtatttactcttctggccggagtgtttgagaaaaaatatcgcatcagttgaaccataaaaatagaggtgatactcatggctttactgaaactaaaagagataagtaaggaatattcaggaaaaaaggttcttgatacggttagtctgaaaattcaatcgggagacatgaaagtagtcatggggccatcaggttgtggaaaaacgacgcttttacgctgtctgcttcgattagaagaacctgattatggcaatatttattttcacgggaaaaatatttacgacaaagaatttactattcttgagttcagaaaaaaagttggttgtgtcttccagaattacgctttgtatcgccatcttaacgtcatggataatattacccttgccctatgtaaagtgtttggcatgccgggacaactagcccgggagaaagccttacatgagctacaaaaacttgatatggcctcgcatagcgcgaaatacccttcgcaattatcgggcggccagcaacagcgcgtcgccctggcccgaacaatggtcaccgacccagaactcattatttttgatgagccgacgtctgcgcttgatccgctcatgactcgtgaagtcggaatgttgatcaagcaacttcacgacaatggcgtcactatattatgcgtcactcatgatattcgcctcgccagattactaagcgataacgtaacgtttcttaatcatggcaaaattcgtgcagaaggcgcttttaccgatcttgccttacgagaaacggatccagatatccactgtttttttagcgaggcacaacgatgatcgctggctggtctctcttctttaatgacctgactgaacaactgccacttgttgtggacggtattaaagaaacctgtaaacttgcgctgattgtttccatcaccggttttttgtggggaattattattttctttctgagcctgagccatcgccccgtggtaaaagccataactcgactgtacatggatttctttatcggtacgccactcattcttattctatttgttatctattatggtttacctcaatctggcattcacctgtcctcttttaccgtggcggttacaggttttaccttgaatgtcggcgcatataatgccgcgtacatgacaacggcctataacgcattgaataagtatgaaacggaggcagcagtcgttcaggggttgaacaaacggcaggtctttttgtggattatactgcctcaggtattgctgtcttccattccagccttaacgaatcaggtgattaataaccttaaagacagcaccatcgtttttcttatccaatatactgagtttttcgcgcgaattcaggaggttgctgcaaccagctttaaattcttccatgcttacctttttgccgccatagtgtatcttattggcgttacctttatcgtcggtttgacccggtttttagagcatagactgcttcgccattacggtcagggttactgagttgtactgcactattctgattaattcaccactgacattatcaaagttatttttatttagcgttgattaagattttaaccttcattattgcgttagatgtccattctggtctaagtcttactccattgaggatattatggcgctaccacaactatcaatatggcagcccggcgatgggttaagaaaaataaagtataaatatcatgtttgtctcattgtcatattctccgtccttatacggttgctgtttttaactgaccgctacctttggtgtgacgaagcgtccagcgtgctgattagtcgacatagcgtagataatctgctcttccatgccgcttttgacgtgcatcctccgctttattatctgttactgcatgactggatgatattatggggtgatagcattgcagcggtacgctctctcagtctactctttgggatcctgacagttgtgctggttatcgcgcttacgcgatggctggcaaatgaacgtacagccttattggcgggatggttcgccgccctgatgccgatggcagtccattacagtcaagaaacgcgcatgtacgcgttaatgggaatgctaacgctcgctgccgcgttagcattgatgatgtggataaaaacacccacccataatcgctatcttgtcgcgtatgctttacttatgacgttcagcttttacacccattatttcaccctatttacacttattgcccactggatcgcagtaacaatattatcctgccaaagccataaaacggcctgctaccttaaacttcctggctggtggtttgctaacctggcgattgctgtcgcttatctcccctggttgcccgtattgtttaatttactgactcatctggcgcagttgagagccggtaatgatatcggttggattccccccgtaacatggcgtgacctgcctgcgatgtactggcatttttttaccggaaacaacggacagggttttccgtcgttcattctgtggctggctgtaggaggttttatcggtactgtggggcgaatatctttatgcaacggagaatatgaaagatatcagctgatattattttgtaatctggtcatccctgtaatgctggtcttcatcatttcctggtggatgccgttatttatcgatcgttatttcttcttctcatcgctgagcattcctcccctgctcgcggtattacttacccgcgcaaaaaaagcggtttgtggcttctggtttatcttattcaccttattattcggctatggttcatatcataataaccctgagcacatagacgagtttaaaccactggtaaactatattaatacccgtcaccagcctaatgatgccgtggtagtcagtaaaatgttcgattatttaagttatgtgtattataataagcgagattatcgtacgtttctttatacaccgcctaacgcacacggaacatcaggcagaccgaatgcctatggctttggttcactgttttatgcgcaagccgatcagacatatattgatactctgacaacgctttcaaaaagttaccatcgtgtctggttggtaagcggcggtaactttagtcaggattaccccttgccgtcagaatggcaaaatatcgcaaaattcagaagtggtagatttcaggtacaattatttgtaataccaactcaacaggcgcgtcaaatgcaatgattaccgttttctatccagtgcagtgataaacagtactgccactgccagaccgcctaaaagtaaggtccagccaaacgcttcaaaaacctcaatcatatcgcctccaggtaggtgatattaaataaagatggctatctcagcgtaacatttaaaatatcaattaatgtgcaataatcgctttatgtgtttgaataaatattgttcttcctgcatttaattgcattgttattatcaaagggcttaatacgcgtacatcaacgattattaattatcagcttataataatatgactgttcaattcatttatcagctattattatcctctatattctttaagataaccgcttaattcataatatcgcctttattcgtcgcattaaattactcactcacctgattaatgcttgcctaacgattgcttcgttgttttaattccagcgcgaaattatttagtgagagaacaatgaagcatacacaacaatcaggcgcaaaagtctataacccattcacgcttagcttatatgactggtgggtactcaatatctcaaacaaatatgcctggaagtgtcctactgatacgcgactacttcctttcttcctgcatcacatgggcgagactcacctggatattggcgtaggtacaggttattacctgaaacatgcacctgcgactcatgccatttcgctgatggatttaaatccggatagcctgaaaatagccgccagccgagtgggtaatacgaaaatccgcgccacactacaacacgatgttttcgacacgttcccggcggactggcacgggcgcttcgattccgtttcgatgtactatcttctgcactgcttacctggtgagatgacaacaaaagcgaaggcaattaaaaatgccggtatggcgcttaaacccggcggcacactttttggcgccacgattctgggcaaagaggttcctcacaatgcttttggtaagaaattaatggctgtttataacaagaaaggaatattcagtaataccaatgattcagccgatacgttacgcagcgtgttggacgaacatttcgctaaggtgactttggagcaacatggcgccgttgcgctattttccgccactacgccacgctcatcgtaagtacaggcacttccgagcggtcggcagcgcgatcatgtgggtttaacccgttgattaaacattggattacggaatagtaattgcttattttatttgtcatacaaataagtataatacccgcttccgatgtagacccgtcctccttcgcctgcgtcacgggtcctggttagacgcaggcgttttctgtatggaatacgccatcccctctgatagatgccttgtttgccttaagcagttaaccccgcctgaagcaaacgtcatacaggacggtcagtcacgcttacgcggcatcatccgtaacagcgtattgtctttccagaaatagtgatgcatcaaagcagcgatggcatgaagtccaataacaaaatagcccagattcgccagcgtgacgtgccaggatttcagcatatctacgcgttcaaagttagcttcggcggcatggggcatagtaatgccaaatgcgacccagggattaccgcggttatacatcatgaccagaccaataacaggcagcgcgataaataacaggtaaatcaccagatgtcctaaatgcgccattccggtcatcatcggttttggacgaggaacaatgggcggcgtgggatatttcagccgaataaacaagcgtgccaccattaaaagcaaaatagtgataccacatgaaacgtgcgtcatattaaaccagggccgataactacgcggcgcaaaaccgcgcagctccatcgcggcgtaagccacaataaccagaaaaaagactaaccagtgaataccaatttgcaggccggaatacttattgcccatagcgcgtcctgaatgaaagccgtaaagcgacaacataaccagcttttataaataattcatcaaatttatgaaatggtggtcgcacttgcccgttcaccctcgcaaacgggcgatttttagcgtaaagctctctgtcctaacgcactgcgcagcgtagtatctgcctgcaatacctgccatgcgttttcaatatcgcgtgggatatcaacgtgaatgataaaatctttaccacgcggtccataccctgtttcatcgtcacgcaaacggggcagctcgccggcaatcagagacagataacgctccaccgtccagatgccctcttcaacattggcaaaacgtgtaccgtcattaaggtggcgcagtaccggaacaaaaccaggaaaactcagccagcgcggcgcatcggtgtcgtcgtttgtcacgcgccggaatgccgcgatagtgcgccgctgcatggtggggtcttgcacaacgatagccgtgttaatgttttctttcgcctgacggatcagtgcgcaggagaaacgggcattttcgccgcaattagttgaccgatcttccagccaaattttctcagccggaatatgccagaactggttcgcgatatccgcaaggatcgcggcttcagcgcgtccgcttgtgcgaatagtgtggtagcgcggatgccgggcaatcacggcgtacaaaaacggcgtcgaatgacctataccgccgctaatcagtaaaggaacgccttgcgctttggcgatgcgacaggccgcgtcgatagtggggatcaccgcattgcccgccaggacgacgcaatccgacgaataaggttgttcgccggaaaaatcattttgcgccagccactgtccgacggtattcaccgccagcaatgtttccgcagagagcgccggaaatggcgttgtattcataattcctcctttttgttccgaacttgtaccggatcgctttgaaagacgtcgtcgcctggctttttaggccgtaatctgatccatggcctgtaaaatacgcttatcggaaataggataaggcgtaccgagctgttgggcgaaataactgacacgcagttcttcaatcatccaacggatctctttaacatcatcatcttcgcgacgcgctggaggcaatttatttatccattgttgccacgcctgctggacgctttcgactttcagcatttgcgcccgatcgcggtgcggatcgacagccagtttctccagccgcttttcaattgcctgcagataacgcagcgtatcgccgagacgtttaaagccgttgccagtcacaaaaccacggtataccagaccgctcatctgcgccttgatatcggaaagccccaacgccatgctcatatccacccgccctttcagacgcttattgatattgaatacggtcgtcaggatccgctcgacctgcttcgcgatatccaccacagtatcattcagctcggcgcgtaccttttcgtgcagcgcggtgaaacctgcttcgctccacaccggtccgccgttggcatctatcagcttatctaccccgcaggcgatacagtcatcaatcaactccagtactttgccgtacgggttaaagtacagccccagcttggctttattcggcaatttctcatgcagatacttaatcggtgaaggaatattgagcaacaacagacggcgtaaaccgcaccacatcgcctgttgttgttccagcggattatcaaacaatttgatagcgacgctgtcacgctcatccactaacgccggccacgccttcactttataattaccgcgtttctgttcgtagctttccggcagctcgccgaaactccagatatgcagcccgctctgctcgatgccgtcatccgccaccgccgagagcgtctcctgcactttgcctttcagcgcatttttaagctcggcgagcgaacgcccttcctgcagtttcttgtttttgtcattcaccacgcgaaacgtgattttcagatgctcgggcacctgatcccaatgccagtcttcccgatcgaccgtgacgccggtcatccggcgcagttcacgctccagagcgtccagcagcggcagctccagcggcgttacgcgacctaaaaacgcttcagcatagtttggcgccggaacaaagttgcgacgtaccggttttggcaacgatttaatcagcgcaataactaattcacggcgcagccctgggatctgccattcaaaaccgctctcgtcaacctggttaagtagcggcaacggaatatggacggtcacgccgtcagcatccgcgcccggttcaaactgatagctcaaacgcagcttaagattgccctggtgccagaagttcgggtaatccagtttgctgattttttccgcgccttctttaatcagcatacttttttcaaagttgagcagatccggcgtctcgcggctgatttttttccaccaactatcaaagtggcgggcggaaataacgtcatggctaatacgctggtcataaaactcaaacagggtatcgtcatccaccaggatatcgcggcggcgagatttgtgctcaagttcctcgacttccgcacgcaattttagattctcacggaagaaggcgtgacgggtttgccagtccccctccaccagcgcatggcggataaacaactcgcgacacaacgccgggtcaatctggctgtaattcactttgcgcgcggcgacaatcggcagaccgtagacagtaaccttttccgtcgccatcaccgcgccttgcgcccgctcccagtgcggttcgctatatgaacgtttaatcaggtgctgggctaccggttccacccattctggctcaatgcgggcagcgatgcgcccccacaggcggctggtctccaccagttctgcgaccattgtccatttcggcggttttttgaataaaccggaaccggggaaaatagagaatcgggcgttacgcgcgccggtgtactcttgtttatcggcatctttcatcccgatatgcgacaacagtcccgttaacaacgcaacgtgaatttcccggtactctgcgggttcgctgtttaccggaatccccagttcttttaccacctgacgcagttgggtatagatatcctgccactcacgcacgcgtaaatagttcagatagtcggtgcgacacagacggcggaattgattcgacgacagggccttttgttgctcgccgaggtaattccacaggttaacaaacgccagaaaatcggattccttatcatggaaacgccggtgtttctcatcggaagcctgctgcttatccactgggcgctcgcgcggatcctgaatagagagtgcggaagtaatgatcatcgcttcgcgcacacagccatgtttttgcgcttccagaaccatacgcgccaggcgcgggtcgaccggcaactgggataattgtcggcccagtggcgtcagcttatatgccgtttgctgttcgtcggcggtaatcgcccccagctcttccaacaaacgcacgccatcctgaatattgcgcttatccggcgcttcgacaaacgggaaggcggcaatgtcacccagccccagggcggtcatctgcaaaataaccgacgccaggttggtacgtagaatttccgggtcggtaaattccggacgtgacaaaaagtcatcttccgaatacagacgaatgcaaatcccttccgatacgcgcccgcaacgccctttacgctggttggcggaagcctgtgagatcggttcaatcggcaggcgctgcactttagtgcggtagctgtagcggctgatgcgcgcagtgccaggatcgatcacatacttgatacccggcaccgtcagcgaggtttccgccacgttagtcgccagcacgatacggcgtccgctgtgcgactggaaaacgcggttctgttcgctgttcgacaagcgtgcatacagcggcaacacttcggtatgccgtaagttcagcttgttcagggcgtcggcggtatcgcggatttcccgctctccgctcataaaaatcagaatatcgccgggactttcacgccccagttcatcgacagcatcgaaaattgcctgtagctgatcgcgttcagtgtcgtcagcctcttccacaatggggcgataacgaacttctacgggatacgttcggccagagacttcgataatcggcgcgttattaaagtggcgcgagaagcgttccgggtcgatggtcgcagaggtaataatcactttcagatcggggcgacgcggcagaagttctttcagatagccgagcaagaagtcaatattcaggctgcgttcatgcgcttcatcaataatgagggtgtcatactgcatcaatagcctgtcctgctggatttccgccagcaggataccgtccgtcatcagtttgaccatggtgttgctactgacatgatcgctgaaacgaactttatagccgatgcagccgccaggctccgtttgcaactcttcggcaatgcggttagcgacggtgcgcgccgccagacgacgcggttgagtatgtccaataagtcctttaattccgcgtcccagttccatacaaattttcggcaactgggtggttttaccggaaccggtttcccctgccacgatcaccacctgatgatcgcggatcgcttccagaatgtcctgtttcttctggctaacaggcaaattttgcggataagtgattgaggggcgcgccgcttcgcggagggcgacctgcgccgcagcctgttcaatttctttcgccatcgtctggaaaatggcctgttgcgcatcaggattttttactttctttacgccatgcaggcggcgcgcaaagcgctgtttgtcgcgcagcatcagtgcatccagccgctgctgtaacacctgaagcgtcaacgtagattgttcagtcataaagctcttgggcaggattctgcctgtttaaaatcgttttaaatgataggtatagagtaccacattggggctttttttgcgttgttcaataatttcgaacaaagggttcgatatattgcgctatccctgcgacatatttgtgaataaagtgtcaacaagcaacggggcacgccccttcaaacacataaaaggaaacacccatgagcaaggtattagttcttaaatccagtattctggcagggtactctcagtctggtcagttgactgactattttattgaacaatggcgcgaaaaacacgtcgcagatgaaattactgtccgcgatctggcggccaaccctgttccggtgctggatggcgagctggtgggcgcgatgcgtccgggcgatgcgcctttaacgccacgtcagcaggacgctctggcgctgtctgatgaactcattgctgaactgaaagcccacgacgtcatcgttattgcggcgccgatgtacaatttcaatatcccgacgcagctgaaaaactactttgatctgattgcccgcgccggtatcactttccgctataccgaaaaaggcccggaaggtctggtaaccggtaaacgcgcggtggttctctccagccgcggcggtatccataaagacaccccgacggatttgattgcgccttacctgaaagtgttccttggttttatcggtatcaccgacgtgaattttgtctttgccgaaggcatcgcctacgggccggaagtggcagctaaagcccaggccgatgcaaaagccgcgattgacagcgtcgtggccgcttaaatatttttgcctcccgtttcgacgggaggtgacttcttaggtttgtagcgcaaatatcctaccacgccgctactgccgccatcgctgggatgcgttaccccatcattgacttcaacgcaggcgaaatcaaaaggcgacatattttcgatgcacgccacattgaccccatattgatcgggattggatcgacgctgatgaaaagtatatatcccgcataccgaacagaaaaaatgcaccgccttgcccgtattgaagcgatattcggtaagcttatcctgcccttttagcactttaatacccgacagcggcgcagacactgccaccgctccgcgcatcctgcaaaaggaacagttgcagcgcctggcggtatgaaagccatcgctaagttgaacggtaaacacgacgctgccacaatggcaggcagcagataatttttcagacgtcatacctggttactctcgcgaatagtgataccagccaacagtatagaaatagccttccggttcgcctaatgtaaatacgaccttcgtattcagaaattacccatataaaaatgcattttgcggtaaaaaaattgtcgggaagcggttatttacgcatccatttgccattaattccctggacatattctcccggcctggcgcgctcaaccagtttttgccctgccatcttcgccacctcgtccacgggaagatgattgctatccgctaactgctgataactggcgcggcgggcatgattaatatcaagcaccagtttctgggtttcggcatcattctttaaggccaccagatagccattcagcgtttccccgacccggccctgcgtgcgcgcttcgtccagggttaaggcccacacagaaggtgtgagcaagctcagcgtcagcacccatagtattaaatactttttcattatggcctcagaatagatcgctgcgtgatttcaggagttcttcaacgtctttatcgactttgatatgtatttcatgctcgatctttacattcatgttgatggtaatcggctgttccggcgcggcgacttcaatacgtggcgtgcaccccaccacgataaatgacgcaagcgctgacagcatggcaatactcattttcattatttatcctcacagtccttgtctttccggcaaggaggttgcggcaacgctgtattttgttcaagccatgcctgtaaattgtcgccaaaacgcaaactgcgccacagcgtaaacacattttcttcatgggtatagttcaagttaacgatcgcggttttaccatctacccggcttttgccggtaatagccgcctgcatcgttagtacgcccaggttatcaacgttaattttcgtccacgaatgcgtaatctccatataacgtagccagttgatcgccgagcctgccgtgacattatccttcaccaccgcatccgcagtatctttatcgatacgcaacgtcattggcccaggattcgtaagccagccatctttgattatccatttttcattgttcagccacagcggcagcgcgccgctgaccggaccagacatggcgaattgctttggatttatggcgctaatcaattcgctggatgaaatattttgcacccgcaaaagcgccgggtcgtgctgcggcattcgcaactgtttcataatgatttgaccgcccagcacgtctacgctgacatcgcttagcagtaatggattcgactcgctccagggataaccgccctgtaaatcagcggtgatatttttcgccgtgacctggttaactatcccggcgatacgcagcgagatgggcccgcgcgtccccaattgccacgcgccgttgtggaagcgaaatggcagaatgaaatcgacgccgttgattttgttatcaggcatccaggcgctgccgccttttaacacgccgtgtccacctgcttcaaatccctgcccctgcgcagcggaaaaagccacctgcgcatacagtgagccttcgcgcagcgtcattttccagtccggtggaagcaacggctggaaaacgataagcgactgcttcggccaccaggcctgtccacgaaggcgttcgccatcccagcgcccattcagccgtaccggccctatcgcccccgcccgaaggtcgcctttaaactggaacagggttggctctcgcccttcaacgctaaaattaagggtagaaggcggcagcacgctcccactggtaaatacggttttccccgccaccagagacagcgcgccctgtagcgacggcgttgtggcgtcgcgaacccagacaataggtttattcagcgccagtcttggcgatgtgacggtcattgcgccatagtgcaactgatcaaaaccggtggacaaactggtcaacctgatggtgttatcatgccattcgccctgtccggcaatatcccagtgggcgcgcattggcgtaaagcttccttgcccccaatagcgccaccgccagcgaccagcatcagggagaaaatcattggccaggccatcaagatgaagaacgaaatcgcccatctcattttcgtgcgcccgtaaaatagcctgtaatcggccatcaacgccgcgcggcgtcaccttaacgcccgccagcggccaacgaatttcatcaatatctaacgcatcaatcacccgcccgcgcgagcgtagcaatgcgccaggtgcaaaggtgagctgcggatcggccagactgccgcggaacatagcgggcaatacggcataaaagattaaatccttctgtttagcctcgccggtaagctgtagaggcatctcactgctatccatgctgagttttcccgggccgatagtcagtacagcgttcgctttaccggcatcgccctgggtcagaatattcaggcgtccactgacttgcgcattatccggcccggcttgccagttatcgatattaaaagccagacgtccgctcaaggggaatccctgatatggccagttccagcggccatcgctgatggtaagccgctgacgcgttaccgcccaggggagatcgagaatcgggtcaggattacctcgcgccatcacgatgagctgtccggcgttatcacgccactccagttccgcatccaccagcgacggttcctgcggcagacgcaaggtcgctgccgcatgaccgctgaccggcaggccatccggtaccagcggcaacacaaattcccccgccaggctaacgggaggctggttggccagcgcggcgatctccagttggctcaccgtcaatgcctgaccgcgtagctgcccttgaaattttactttttcgccctgataacgtatctgctgaatgaccggcgtcatggagatcgccagcttgccctgccattccggccagggcgcgagaatgacattatcgatgttaatccaggtattgggcagcattgactgccactgcgccagcgtacgcggcgcggcgggagaagcttccgtagcgggcagtttcgccaggcacgcggcatccagtttaaggcttttaatattcagcaaccaacggctgggatgcgtcagttccgcctgggtaatatgcgctaacgaacaatcattgaccagatagcgaagatcgggaatcactaacccatgacgtgtcaggcgtggactttgttccagagcgatacgggtaccgacgggtagccaaattcccgccagagtgggaacccacagcccgagggtcatcagtagcgtcagagggataagaatcagcagtaacagtagcgcaagggcggctttatatttacccttcatgggccattaatttcctgatttaacgaaaaattcagtcggctatctctttattttggcatgattgcccgtacatagcctaatagttcatgttgcaggggcgccctccggctatttgaggcgttgtggagaatgataacctaaaattattcattatatgtatgactatcaattatttttgattttttgtaagataattttaagcatatttgtgtgattcaaacatcactggagaaggtcatatgaaactcgccgtctatagtaccaaacagtatgacaagaaatatctacagcaagtgaacgaagcgttcggttttgaactggagttttttgattttctgctaaccgagaaaacggcgaaaaccgccaatggatgtgaagcagtttgtatcttcgtgaatgacgacgggagccgaccggtactggaagagctgaaaaaacacggcgtgaaatacatcgcgctgcgttgcgccggatttaataatgtcgacctggatgccgctaaagagctcggtttgcaggtggtccgcgtgccggcttattctccggaagccgtcgctgaacatgcgattggcatgatgatgacattgaaccgccgtattcaccgcgcttatcaacgcacccgcgacgctaacttttcccttgaggggctgaccggctttaccatgcacggaaagaccgctggcgtcatcggtaccggtaaaatcggcgtcgccgcgctgcgtatcctgaaaggctttggaatgcgtttactggcgtttgatccctatcccagcaccgccgcgcttgacctcggcgtcgagtatgtggatctgcaaacgttgtttgccgaatcggatgtcatttccctgcactgcccgctcacgccggaaaactaccatttgctgaaccatgcggcattcgatcaaatgaaaaatggcgttatggtcattaataccagtcgtggcgcgctgattgattcccaggcggctatcgaagctctgaagaatcagaaaatcggctcgctggggatggatgtgtatgaaaacgaacgcgacctgttctttgaagataagtcaaacgatgttatccaggatgatgttttccgccgtctgtcggcctgccataacgtactgtttacggggcaccaggcattcctgaccgcagaagcgctgatcagcatctctgaaaccacgttacaaaacttaagccagcttgagaagggcgaagcctgcccgaacgcgctgttctaatcctgtcgctcccctgcgctcaggggagcattttcggataacccctgaagatctatccggtcatatcattactatagtcagtgttaactatcagattacagagaatatcaatgaagaaaatcgtcacgctggtcgccctgagcatcataatgacagggtgtgtgagcagtggaaaagtgtccgtcaaacgcgagcaactggagcaccaccgctttgttctggaaagcgtaaacggtaaaacggtcaccggcccggagctcagctttggcgaggacatgacggtatccggcaaaatgtgcaatcaattcaccggcgaaggaaaactgtcggacggcgaattaaaagtgaaaaatttagcgatgacccgaatgatgtgcgcagatccacagcttaacgcgctggacggcaccctcagcgagctcttcagcaagggcgcgcaggtcgatttaaccgcgaaccaattaacgctggcgacggcagaaacaacgctaatgtataaactggcggatttagcgcactaagccattaagtgaaaagttatacgcgtcaggcgaaacgccgcgcttaataactcccgcagcttccggcggcaagcgactgttcgctacaacgtttgccgttgggtagcgcgcacataccaattactgaaccatcaagctgccgggccgctgaaagcgaaccgccaatcatagcgcaattcgcttcgccggcgctggacatcgccgctttcatccctggcgaaacatgtgccgcggttgcctgctgaacaggttcgctactgcaagccgacaataataacgcggcacatcccacccaaaacgctgcgcgcatttctctcccctctgtttattcatccaaacgacaccgccctaaataataggcagcagaaactgacgcgtcgagaggcaaagcgcgcatttatgcgcttcattaacatttattggcaattttttacgtcttttcggcaagaaatcgccattctcctcccgccagggacacaaaagcgaaaatggggcttgaagggctttgctaaaataaaaggataactacaggatgcgctcacgattatgcgtgtccctcttttttgcgcaatgtaagggtgtcatatgcaaacaattgacggtaatggcgcagtagcgtcggtggcgttccgtaccagcgaggttatcgccatttacccgattacgcccagttcaacaatggctgaacaagcggatgcctgggccggcaatgggcttaaaaatgtctggggcgatacgccgcgtgtggtagagatgcagtcggaaggcggcgcgatcgccgccgttcacggtgcgttacaaaccggttcgctttctacgtcatttacatcatcgcaggggctgctgctgatgattccaacgctgtataaactggcggggcagctcacgccgtttgtactgcacgttgccgcgcgcactgtcgccacacacgcgctttctatttttggcgaccattccgatgtgatggcggtccgccagacaggctgcgcgatgttatgcgccgccagcgttcaggaagcgcaggattttgcgctgatcgcacacagggctacgctgaaaagccgcgttccgtttattcatttttttgatggcttccgtacatcgcatgaaatcaacaaaattataccgctaacgaatgaaaccattctgaacctgatgccgcaggcggagatcgacgctcaccgcgcccgcgcgctgaatccggaacatccggtgattcgtggaacttcagcgaatccggacacctacttccagtctcgcgaagcgaccaacccgtggtacaacgccgtttatgatcatgttgaagaggcgatgaaggcatttggcgacgctacgggccgtcagtaccagccatttgaatattatggccatccccaggctgaacgcgtcatcataatgatgggctccgccctcggcacctgcgaagaggtcgtggacgagctactgatacgcggagaaaaggtcggcgttctgaaagtccgtctgttccgccccttctccgccaaacatttgttacaggcattaccggaaaccgttcgcgctatcgccgtgctggatcgcaccaaagagcctggcgcccaggccgagccgctttatctggacgtgatgaccgcactggcggaggcctttaataatggcgagcgcgaaacgttgccgcgcaccattggcggccgttatgggctatcatccaaagagttcggcccggcgtgcgtactggcggtctttaatgaactcagccgtgcgaaacccaagccacggtttacggtgggcatttatgatgacgttactaacctctcgctgccattaccggaaaataccctgcccggcagcgctaaacttgaagcgttattttacggtctgggaagcgacggcagcgtatccgccacgaaaaataatattaaaattatcggtaattctacaccgtggtatgcgcaaggttatttcgtttatgactctaaaaaagctggcgggctcacggtatcgcacctgcgcgtcagcgagaaacccattcgttccgcttacttaattgctcaggcggattttgtcggctgccaccaattacagtttatcgataaatatcagatggcggagcgtctaaagcccggcggtatctttctgcttaatacgccgtacagcgccgacgaggtctggtcgcgtctgccgcaagaagttcaggcggtgttgaatcagaaaaaggcgcgtttttacgtggttaacgcggcgaaaatcgcccgcgaatgtggacttggcgcccgcatcaataccgtcatgcaaatggctttcttccacctgacgcatattcttccgggcgatagcgccctggttgagctgcagggcgcgattgccaaaagctatagcagcaaaggacaggatctggttgagcgtaactggcaggcattggctctggcgcaggaatcgctggcggaagtgccgttgcaggcggttaatccgcatagcgcgcatcgcccgccggtcgtctccgacgccgcgccggatttcgtgaaaaccgttaccgccgccatgttggcgggcctcggcgacgcactgcctgtttccgccctgccgccggacggaacatggccaatgggcaccacccgctgggaaaaacgcaatatcgccgaagagattcctgtctggaaagaggaactgtgtacacaatgtaatcactgcgtcgctgcctgccctcactcggcaattcgtgcgaaagtcgtttccccgcaggcgatggagaacgcgccagccagtctgcattcgctggacgtgaagtcccgcgatatgcgcggccagaaatatgtgctgcaggtcgcgccggaagactgtactggctgtaatttatgcgtagaggtctgcccggctaaagatcggcaagatccacagattaaggcgattaacatgatgtcacgccttgagcatgtggaagaagagaaagtgaattatgacttcttcctcgacttaccggaaatcgaacgcagcaaactggaacgaattgatatccgcacatcgcagctcattacgccgctgtttgaatattccggcgcctgttccggctgcggcgaaacgccgtatattaaactgctgactcagttatatggcgacagaatgttaatcgctaacgccacggggtgttcctctatttacggcggtaacttaccctcaacgccttataccaccgatgccaacggacgcggcccggcatgggcgaattcgttatttgaagataacgcggaatttggtctcggtttccgtctgagcgtggatcagcaccgggcgcgcgtcatgcgtttactggcgcaattcgccgatcgcatcccggcggaattaaacgatgcgctgcatgccgaagcaacgcctgacgttcggcgtgagcaggtcgccgcattacgccaacatctgaaatcggttgcgggcgcagaggaactgttaaaggatgctgatgcgctggtagaaaaatcaatctggctgattggcggcgatggttgggcatacgacatcggctttggcggtttagaccatgtgttaagcctgacggagaatgtcaatattctggttctggatacgcagtgttactccaatactggcggccaggcgtcgaaggcgacgccgcttggcgccgtcactaagtttggcgaacatggcaagcgtaaagcccgtaaagatcttggtgtcagcatgatgatgtatggtcatgtttatgtcgcgcaaatctcgctgggcgcgcagttaaaccagacggtgaaagccatccaggaggccgaagcctggccaggaccgtcgctgatcattgcctatagcccctgtgaagaacatggctacgatctggcgctaagccatgaccagatgcgccagttaacggcgaccggtttctggccgttataccgctttgatccccgccgtgcggatgaaggcaagccgccgctggctctggactctcggccaccgtctgatgccctggcggaaacgttgcttaatgaacagcgtttccgtcgcctgaatgcgcaacagcctgaagtagctgaacaattatggcgagatgccgcattggatttgcaaaaacgctatgactttcttgccttgctggcaggaaaagcggaaaaacccggcgcagattaaaaaatattctaaggattaacctggaaacaaaaaaagcccgaacatccgttcgggcttgtcaatttatacgctggaaagcaaaggttaacgcaatggcccagcgacaaaatgaatatgtgacaataaaggcatataacaggcgtagaatatcgtaaccgaatgatattgtataatttttattttgtataatacccccaaaagcattcgtataaattatatctatttcactgcgaattatttcattaattattgaattaaacggtaacatctctttttaggtctttcctgacaaggcagaaataacgttttaacgtcaactcgctgattatttacgtggaatacgcgtaatattacgtcgccctcccctgtaggtagtccccgcagagtatcgtggagcagcacctaaaatgtgacgtatgtcattgtacataaagtgcctttagggagtagaatttcagtggatacttaaacaggaggttttatgaacagaacgattcttgtacccatcgatatttcagattcagaattaactcaacgcgtgatttcgcatgttgaagctgaagcaaagattgacgacgctaaagtgcactttttgactgtaatcccgtctttgccctattacgcttcactgggactggcttattcagcagagcttcccgcaatggacgatttgaaagccgaagccaaatctcaactggaagcgattatcaagaaattcaaccttcccgcggaccgcgtgcaggcgcacgttgcagaaggctctcctaaagataagattctggaaatggcaaaaaaattaccggccgatatggtgattatcgcctcgcatcgcccggatattactacctatctgttgggttccaacgccgcagccgttgtgcgtcatgcggaatgctccgtactggtggtacgctaaatacccgagcccgcataagagagtgcgggctcaaatcaatcatcatcgcctagtgactgacactttttgaaaacagattgattacgattacgccgcagatgataagcaacatgccaataatagccggcacatccagtttttggccaagaaacaaccatcctatcaatccaataagaacaatccctaccccagaccaaatggcataaatgatacccgcagggatggttcgcattgggatggtaagacaccagaacgcaatacaatatccgatgatagtaacgaggctcggtaccagacgcgtaaaactatctgataattttaatgagatcgtggcgataacttctaccacgatggcgataaatagaaagattacagcttctttagtcatacatctcttcgttccaatatttttcgggtcgtgatgatatcttaagtaatacggatgacagaataaagacgcttttgaaccattgcatatcttgccataaaaacgtgctggcattcgtcgccgtaatccgtaccatacgcgacatacttttgcctgctggctgttgacggcaggagcgaacccggcatttatcgccagccaaatggggcatgaaactgcgcagatggtgtatgaaatttacggtatgtggattgatgacatgaacgacgaacaagtagcgatgttgaatgcgcggttatcgtaattgcaaagtttgcccccaatttgccccatttagtaccagagaactgaaataatgcaagaaattcaaaagaatacaaagaaagagcaatacaacctcaacaagttgcaaaagcgcctgcgccgtaacgttggcgaagcgattgccgattttaatatgattgaagaaggcgatcgcattatggtttgcctttctggcggcaaagatagctatacgatgctggaaattttacgtaatttgcagcaaagcgccccgatcaatttttcactggtcgccgtcaacctcgatcaaaagcagccaggtttcccggaacatatcctgccagcctaccttgagcagctgggcgtagaatataaaatcgtcgaagaaaacacctacggcattgtgaaagagaagattccggaaggaaaaaccacctgctcgctgtgctcgcgtttgcgtcggggtatcctgtatcgtacggcgactgaactgggcgcgaccaaaatcgccctgggccaccaccgcgacgatattctgcaaaccctgtttctgaatatgttctatggcggaaaaatgaaagggatgccgccgaagctgatgagcgatgacggcaaacatatcgtgatccgcccgctggcttactgccgcgagaaagatattatccgttttgctgaggccaaagccttccctatcattccttgtaatctgtgcggttcgcaaccaaacctgcaacgccaggtgattgccgacatgctacgcgactgggataagcgctatcctggacggatcgagacgatgtttagcgccatgcagaatgtcgtgccgtctcacctttgtgacactaacctgttcgatttcaaaggaatcactcacggttccgaggtcgtcgacggcggcgatttagcgttcgatcgtgaagagattcccttgcagcccgctggctggcagccggaagaagatgacaccgccttagaggcgttgcggcttgatgttatcgaagtgaaataatctgcaggcgtctcagcactccgctgagacgccatgctatcgatcattttaatagccgtacccggcatgacttgcctttgatcttcccgttttgcaactgcttccaggctttttgcgctactgcttgacgtacggcgacgtaaacgtgcattggatgcacgttaattttgccaatatccgccccgtctaatccaatatcgccggtcagcgcgcccaaaatatctcccggacgcattttcgcttttttgccgccgtcaatgcatagggtagccatctctgcggccagagggagtaacggctgccgggcgggcgcattcagccagttcagcttgagttgcagcatttctgaaagaatattcgcccgctgcgcctcttccggcgcgcagaaactgatcgccaggccgctgcttcccgcgcgcgccgtacggccaatacgatggacatgcacctccgggtcccaggccagttcatagttaaccaccagttcgagcgatttaatgtctaaccctcgcgcggcaacgtcggtggcaaccagaatgcgcgcgctgccatttgcaaaacgcaccaacgtctggtcgcggtcgcgttgttccagatcgccgtggagcgccaacgcgctttgtcctaccgcattaagcgcatcacaaacggcctgacaatcttttttggtattgcaaaataccacgcaggacgctggctgatgctggctaagcaacgtttgtagcagcgaaattttttcatgcgcagacgtttcgaagaactgttgttcgatagccggtagcgcatctaccgtatcgatttcaatacgtattggctgctgctgtacacgaccgctaatcgccgcgatggcctcaggccaggttgctgaaaacaataacgtctggcgcgtcgcaggcgcaaagcggatcacctcatcaatggcgtcactgaatcccatgtccagcattcggtctgcttcatccattaccagaatatgcagcgcatccagcgatacggtttctttttgtaaatgatccagcaggcgccccggcgtcgcgacaatgatatgcggagcgtgctgaagcgagtcgcgctgtgcgccaaagggttgcccgccacacaaggtcagaattttggtatttggcagaaaacgggccaggcgacgtaactctccggcaacctgatccgccagctcccgcgtcgggcacagcactaatgcctgtgtctggaacagagtgacgtcaattcgatgcaagagcccaagaccaaacgccgccgttttgccgctaccggtcctggcctgcacacgcacatcattacccgccagaatgacgggtaatgctgcggcctgaacaggcgtcatctcaagatagcccagctcagtaaggttattgagctgggcggcgggcaaaacattcagggttgaaaaagtggtcacaatttactctcgcggtaacgactcatagtcagcaggcgcgtatcctcgcagatccgggcgtttgatgcgacattttaatcggttcttcgtccggcggcgggtcgggcatcggctgaggacggggaagcggctcaggaatgggaacagggtcagtgggaatcgggtccgacaaggacgagtgtagatataataaggtcaaaagacagctcatattaccctccagaatgtcattcagactcttaaagggtagacgcagatagtctacaggcaaaaaaaagccgactaatctaagtcggcgtcgtacgaatcaattgtgctatgcagtaattcaaaaaaggaagtaagacaatatggagcgcaacgcccatcgcttgacgttgcattcacctgcgagagagatattgccccgaataggtagatggtttattgacttcgctcaaatttctcggcgttttttcacccgaaatggtctgaaaagcgcttttgttacaaccatttactgcgatgcaaccataaagtaacaccaccgatcaggacaactaacagaatacaaaacagagaaaagccgaaccgccatccgccgccgggaataccgcccaggttaacgccaaataaccccgttaagaaggtgctgggcagaaaaaccatcgccataagcgacatggtataagttctgcgcgccagagactcctgcatcacctgggcaatttcatccgccatgatgccagtacgcgcgatacaagcgtcaatttcatccaacccccttcccagcctgtcggcgatatcctgcattctgcgccggtgatcgtcgctcatccacggcagccgttcactcgcaagccgggcatagacgtcgcgctgcggcgccatatagcggcgcataacaattagctgtttacgtagcaatgcgaggaaaccgcgcggtgggatttgctggtcgagaagattatcttccagatcgataattttatcgtgtagctcttcaataaattcactggcgtgatcggttaacgcatcgcacacatccactaaccagccgccgcaatctacgggcccggtgccctcctgcaaatcactgaccacatcgtccagcgccagaacctttcgctgacgggtagacacaatgaatcgctcgtccatatataaacgcattgccactaattgatccgggcgttcgtcagtactgccattaatacagcgcagcgtaatgagcgtcccttcccccatacgacttacgcgcgggcgcgagctttcaccagccagcgcatcacgcacgttattggggagtaaaggcgttgaagccaaccagcgggcgctgtccgggtgggtataattaagatgtagccaacagggatgctgactatcgatcacatcattatcttcgagcggttttactccaccacgaccatccagtagccatgcgaaaacggcatccggcacgttcacatccgatcccttaatggcttccacagcgcctccacgttacaactctcatgccgttagtctagctttcgggaaaggttaagcaatctctcattttctcattgcgcaaaaagaatgacgggaacgtgcgaaaaaagcgccttagcaacaggcgcttaccaaacatgtattatcaggcctggccgcgcctggtgatggtcgaaagagatgatacatgagagtgcgacagcgcatgttcactgtaacccggctggcttaaacgaaatttgtcggttttagtctgtaactcgatcacctgcgcctttaaaacatccgaagaagcagatagcgcttcaaccattaagacattgctatgggttgcgctttccagatcgctcaacgccagggttatctggttaatgcctttttcctgctcccgcgtggtggtggaaatttcactcatcagcacgtttaattgcccggagccgccaacaatctcctgcatatttttttcagcctcctgcactatggcggccccctgccgcacattgtcatgcgtaacgtcgatcagcgccttgatactttttgccgcctcggcgctacgatgcgccagattacgcacttccccggccaccacggagaaaccttttccatgatcgcccgcccgtgcagcctctaccgccgcgttaagcgccagaatattagtctggaatgcgataccgtcaatcaatgaaataatctccgtcatctgcgaggcacagtcggtaatagaacgcatattttctgtaacccgcaccattaattcaccgcctttacgggcgcattgggttgcacaatccgcctgtatgctcgccattcgggtattatccgcattgtttttggtactcgccgccatttcatctatactggcggcagtttgaattaacgaggccgactgctgttccgtctttacggatagcgacagactgcgcgccgccagttgttcggaaagggtcattgccgtttgcgaagaggatctgatttcacgtaccaacgcggaaatattctccgacaggctattaataccggggatgagtcgcccggcgcaattattgccaaattcggagatatgaatagacaagtttcctgctgcgacctcttcaatacttttcttcacggtattaatcggcactaccagatagcaggtcatataccaccaaagcagtaatgccgagatcagataaatgatattacacgtaattaaaatagggagatcgtgcagaaaagctatttgtaaagtatccaccaaaagaaacgcacataccatgaatagaataatgcatgtcctgacgctgatatttctcaacatttttgacggcctacaaccaggataggagacaggttttatttttatagcatttcagatacctattgccattcgtttctgtgacattctccatattcaataccagaccatcgccatttcccttagtgcaacagataaaatcatctatattcgctatgccaggatattcatccatccatattgacaagtgatgtacttatcaccattttctgcttaatagttaagtcgaaagccagtatattttaatagacgcttaaataagcgaatgactgtttctccgtgttattaccgcggacagcgttatcgcccgttctcttgcagaatcctgagcgtttggatgaggcgttatatcaggcataaaatcgggttcgcgcgagcttgcgctggcggtcctgtccgccagcggcaacgatttaccgactacgcttcgcatggcgctcccagttatcctgtttagcctgcactgttttacgtaacgcgacataacatgccccgccgccgccatggtgcggcagcgccgaacaataagcctgtacatcttcaaactctgtcaaccagcgggccacatagcttcggacgatattggcatgcgacttcgcctctcgccctttaccatgaatgatcaggacattacgcaacccctctttctgcgcctccaggataaaacgaaacagcatttttcggcacgtttcgaccggctggcgtaacaaattgaggctggcctgctgagggtatttcccactgcgtaacttgtcgatgacaccctgctgcaatccttcccgacgaaattccagcggttcattcagaggcagaatatccagaaagcccgtcgtcaggaaattatcaagctgaagcgtgtcgatacgctggggcgttttaagattacgcgttggctgccagtgtacatcagtatggcgtttcagcggctggacatcctccatggcgtcaagaaacagcgctttatcgtcaaggttcatggttcatcctccagcgtttttgcgactgccgttatcataaccgtgccctgttataccgacaacggtttacagttatttccaataacagcgacaatgtcaggcaattaaccgcctcgccaggctctctttttctccgactacgatattactgtcgctaaatgtgttatccctgactatcttttaaggagtatggttgcgggtattcctggcatgatatcttgtctcttacgttagattaagacgatgtgagagaacggatgctgagattacttgaagagaagatagccacgccattaggaccgttatgggtggtttgcgatgagcagtttcgactgcgggccattgagtgggaacagtaccgcgatcgtatggagcaactgctaaatatccactaccgtcacgaaggctatgaacgcgtttctgcgactaaccccggtggactcagcgataagcttgcagattattttgcaggcaatctcgccgtaattgataccctggaaaccgccacggggggcacaccttttcaacgggaagtatggcaggcattgcgcgctatcccctgcgggcaggtgatgcactatggtcaactggcggcgcaactgggacgaccgggcgccgcacgcgcagtcggtgctgcgaatggtgctaaccccatcagtattgttgttccctgccatcgcgtcatcgggcgtaacggcactctgaccggatacgcaggcggcgtgcagcgaaaagagtggctattacgccatgaaggctatcttttattatgaatatacaggcaaaaagtgccttatcggtcacacttttatgtaaagcaacaacaaataaattacgtgttttcaaatagataaaaatattcatcaaacttatacttgaattattccttctccgggatagctcagacttacgcgctcaccaaaaagatgttaaaattgacaaatatcaattacggcttgagcagacctatgatcccggaaaagcgaattatacggcgcattcagtctggcggttgtgctatccattgccaggattgcagtatcagccagctttgcatcccgttcacacttaacgagcatgagcttgatcagcttgataatatcatcgagcgcaaaaagcccattcagaaagggcaaactctgtttaaagcaggtgatgaactgaaatcgctctatgctatccgctccggaacgattaagagctacaccattaccgagcaaggcgatgagcagattactggattccatttagcaggcgacctggtgggttttgacgccattggcagcggtcatcatccgagctttgcacaggcgctggaaacctcaatggtatgtgaaatcccctttgagacgctggatgacctgtccggcaaaatgcctaacctgcgtcagcaaatgatgcgtctgatgagcggtgaaattaaaggcgatcaggatatgatcctgttattgtcgaagaaaaacgccgaagaacgtctggccgcgtttatttacaacctgtcccgccgctttgcgcagcgtggtttttcaccgcgtgaattccgcctgacgatgacccgtggcgatatcggcaactatctgggcttaacggtcgaaaccattagccgtctgctggggcgtttccagaaaagcggtatgctggcggtgaaaggtaagtatattactattgaaaacagcgatgcgctggcggccctcgccggtcatacccgcaacgtcgcttaaacgtcagctaaaccattgatgttatcttctgccatatcgttaaatttttctcatttattgatctggcagaagcgcttcctctgtttcattcaccatatttgagttactctttagttacaaactgcgatgacagttgtaaggagaccctgtatggctatgtatcaaaatatgctggtggtcatcgatcccaatcaggacgaccaacccgcattacggcgagcagtttatttgcatcaacggattggcggcaaaattaaagctttcctgcctatttacgatttctcgtatgagatgaccaccctgctttctcctgacgaacgcaccgcaatgcgtcagggcgtaataagtcaacgcacagcctggatacgtgagcaggcgaaatattatcttgaagccggtgtccccattgaaattaaagtggtctggcacaatcgtccctttgaggccatcatccaggaggttatcgccggcagtcacgatctggtgttaaaaatggcgcatcagcacgatcgactggaagcggtcatttttacccctaccgactggcatttgctgcgtaaatgcccaagccccgtgtggatggtcaaagatcagccgtggccagagggcggcaaagccctggtcgccgtgaacctggcaagcgaagagccctatcacaatgctctcaacgaaaagctggtaaaagagaccttacaattggcggagcaggttaatcataccgaagtgcacctggtcggcgcctaccccgttacgccaatcaatatcgccattgagctgccggaatttgatcccagcgtgtataacgacgccatcagaggccagcatttactggcgatgaaagcgctgcgccagaaattcagcatcgatgaaaaagttacgcatgtagaaaaaggcttgcctgaagaagttatcccggatcttgccgaacacctccaggcggggatcgttgtgcttggcaccgttggacgtaccggactctcagccgcgtttctggggaacacggccgaacaggtcattgaccatctgcgctgcgacctgttagtcattaagcctgatgagtatcaaacaccggttgaactggacgacgaggacgattaatccctcttgcgtcctgccggatggcgctgccatccggccaataccctattcctgttactcatctccgccgaggaaatagatccccaaaggaatcgccagcagaatagtgaacaccagactgtaaacgaaaatcattgccgactgaatggcatacatagagcttgtccactcggacagtggaatatgatactgctcaatcacaccgccgatagtcgcgcgcgttaccaccgatgccgcaacgataaacactgccagcaggcataacagaaattttttccccttcgccgatttcagcttcatcatgatcatagtattgtcctttacagatgacttttttacctgatagcaacaataccatgacaatcgcgcgatgtctgctctataaaacgtgacattgtatttacataaaaagtaaaccgctgagattaaagctgatagcactatttcttctttttacttatcgatgatctacgcgtttatcctgggtaaaatacctgttaatcaggtcattctgagctgttatcgtaggaaggagcggaaaacaataatgttcactgaattttttctcaaaaacgcatttaatctggcgatacttttcagttgcggtatggcgttgctggtcgtgagattttggctcagccgtaacgtacagtggaagaaaggattcacgttccatgcggcacagttttttatttatgcaattattattgggaccatcgggagcatcctgaataatgctattgaagattataatttgcgttttatctcttccggggtcattgattttatctgcacctcgctcattgcgcttattctgacgataaaacttttcctgattattaaccaatttgaaaaagcacaggtcaataaaggtagagatgtcaccagtacccgtattctggcacgggtcataaaaataaccattattgtcgcgattgtcttactgtatggcgaacattttggcatgagtctgtccggtctgctgacctttggcggtatcggcggtatcgctgttggtatggcgggcaaagatgtcctgagcaattttttctccggtattatgctctatttcgatcgccccttcagtatcggagactggattcgttctcctgacagaaatatcgaaggtacggtcgccgaaatcggctggcgaattacgcgaattaacacattcgaccaccgcccgttgtacgtgcctaattccgtcttttcatccattagcgttgagaatccgggacggatgaccaaccgtcgaataaaaacggttattgggttacgttacgaagatgccgacaaaattggcctcattgttgacgctatcagaaacatgttgcaggcgcacagagatatcgatcagaaacagacgctgttggtctattttaatgaattcgccgactcttcgctgaatattatggtgtattgctttaccaaaacaacagtatggcaggaatggcttgccgtacagcaggatgtttacctgaaaattattgcgattgtccaggaaaacggcgctgacttcgccttcccaagccagacgctctatatcgatgacccggaggccgcgcctgcgacaaaataaaagatagccggtgcccgataagtgttatcgggcaccgaggcttccctgtccggatggcgggttgttagcgccttccttacggtgatcaacggctcttttcattcaccgtcatggtaaattcaagcacctcattagtgtcgttaacgtaggcatgaggcatgtcggttctggctacagcggagcagccctcccgaataataaagcgtctaccgtcgactgttaatgtcagtgttccctgattaacaaacagtaattcacaggtgtctgccggatgccctgccgattcaaactgttcaccaggatgcattatccattgccagagttccagcatatccggcccgctggttcccgccatcagttttgcgctgccgcctttctcgccgcgccacaacaccggaatagcatcccggtcgataagatggaccatcggctcgctggcgacgttgacaacatccgccacggacactcccattgccgccgcgatcttacataacagcgcaatgcttggattggctttacagccttcaatttccaccagcattcctttactgacgccggaacgccgcgcaagctcatccagcgacatctttttttggctacgaaattgtttgatacgttgggaaacagcttcatttattgtgctgacgtcggcgcccgccgtggtcgataagttgacttttttggtcattggtcgatatcatagaataaaatagtcattacaggattatgcgatgtcttctatgttaccgtcaatcagcccggaactggcccgtatcgctcccggctttcgtgcattaagtattaatgttattgccgctccgattcgcgatgcgcaggtcggagaaatcgcgctaaaagaggcctgtcaggccgtaattaacggccaaccggcgtgggcacaggcgcatatagacgcctggaatacggtgcttaaagcattcggcgcaaaaccaaagcgcaccccctgctcggctgaagcgctacgaaaacgcgtgttgaaggatggaacaatggcggcgctggatccggtcgttgatctttataacgcggtgagcctgcgctatgccgtaccggtaggcggcgaaaatagcgcggcttattgtggatcgccgcggctggttttcgcagacggtagtgaaacatttgatactctgaaagaaggacagcccgccaccgagtcgccagaaccgggcgaagttatctggcgcgatgacagaggcgtcacctgtcggcgctggaactggcgtcagggagtacgtacccgactaagcgcttcagataaagcgatgtggtttatccttgaaagcttgccggaaatgccggttgatgaattgtacgcggcaggaaacatgctgactgacggccttgaaaaaatgatgccaggtttacgttttgaatccacgttgataggtgtttgattgatattgcgtaacaggagaaataccatgtcgctgtttctgacaagttttattttcgaaaaaaaagagtacgacgaagagttttatcaactggatggctgaattgagcgctatacgcagtctgttgatggctatattgggatggaaagctataccgatgccgccagcggaagaatagttaacaattattactggcagacccgcgaatcaatggagctattgataaataatttacagcaccagcaggccaaatcacaaagtcataagtggctttccggttaccagacgattattgcagaaattcaggggtgccataacgttaacctgccccatccgctggcatcattttcagttccttatgcgtaatgcaatagtatatatattaaatgtgagggcacacaagagaatgcctgcgcccctgcattgccggttattcggttctctgtgcaggggcggtgctgatataagtgattagtaaacaggaagatgagtgatatctcgtggtacactaacacgcgtaaccacattgttttcatcgcactctatcaacgctctggcaaaaatactgagctcattaattttcagcccggaattatccaaaaactggcggcaagcgtagtcagaaacaaaaattatgccgggatgaatatcatgttcccgaataaaacgggcctgagcaaatggcgtatccatactcagcacatataccgcccgggttgagtggctacccgctgatttaaggcggtcactatagtcttttacctgccattcacaaactggcgtatccagtgacggaacgacaataatctgcttttttatccccgggatacagtaacccggtaataaattatggctcaccagcccctttgtgcagggtaatggttcgccttcagccagtataccgggtttgagggtcagttgcgttttgccaaaggtgacagcgtgttcctgacccaatgagatataatcctgtgttgttgttggcgtcataaaaacttctccttttaacatttgtattattttagccataataattatttagcaatccgctaaaaaaccaggtgaacatccataataagatgatggtgataaaaagaattatattagacataataattaatatagttttatagtcttcctctgatggaaatttctttcgtgaaactcattgcatatttaaaagatatgtcaatacgttcattactatgcccacgataggttataacttgtgtatatttacctggaacattttctttcttaagagggccataatcccataagccttttaaattttcacgcgctacagtcttattaatgtgaacttcatttacaggattcccgtcgatatccttaacaatagttgtgatggtggcactttcacccggcgataatacagacttatctatactcataactgttaaatctgggcttggcgtattagatatagtttctgtttcaatatactggaactcagataccgatggcacaggcgtgtaccctgacgctgaagccatatccgtttcattataaatttctagtttaatctttgaaccccgatgttccttttggatattaaatttatgctcacatggcttttctcgtttaagtatatgctgagagttatctttattgatctgataatacgtacatactgtagtaaaagtttccgcagactgatagttattatccggatctctgatgcctacatttctggcattcctcgcaatagtcattcccggaaaaggtgtatacttttcaataaaaaagccaagtccattaaactgcaattcgtagctatcgcgaggtgttccaggcctgtgcccaacgctcggcgccgtaggaggagaaaacatcccgacggttgccgcggacgttgtcgacgaatccgccaagacgcttatcggcgcagccgccagaagcaggctatagataataagattatgtttcgacatacgcactgttgatcctttttaaaacattaattcgcatcagaggttgcggtattacccttagcatttcccttatcagaaataattctgacgcggatatatttattctgaagcgattccccattaagactataaggaagaagccaggtggcctttgtcgcacccggtacggattgccaggatttcatttcatccgagatttcccactgataattaaacgcatcagtacagtccgtgttatttacacaaagcgttctggctcgcatttctgttccgacgactggcgcagtaacgcttccgttggcctcttcagtacccggcgtaaaaagcacctccacagaagtgaccttctgcgcaatactgtctgactgcgcttgtagtagtacggtacccttcaccggatgtttatcgtctggtccgcttgcttcaatatgtaatttgagcgagcgggcatcatcgccgatatgggtcaccagaacccgttcaacccaatggccgtcacgctctgtaccaccgagcgctttaaatgccagacccggcgtatctgattgatacttaatatgacgtggtttgagcgacgcccactcctcttcagaacgctcgcgcacgtagtgccactcaataaccttcccctcttctccggcaggaagcggcgtattgatgacaaagttgccgtcctcaacctgaacatcgtcattgataacatttatccaggaacggaaactggtctcatcctgtgtcacccttaccgggatacgctcggaggtcacgcgagtaccccggctgtcagtcaccgttaaataaaggctatactcctgaccgtcggtcgccgtcagcggaagttgtggaaggataaggccgctgcccagactcccctgaagctggagtccggcgagaagctccgcatcacccgaccactcaaccttctcaaccgggtaacggctatctaccgtcgccattaatgtcaccagcgtcccggacaggcctgacaccggcattgccgtaatgcggattttgctggcctgctcccgatacgccatgacgatatcgtaattacgatcaacaaaggcacgccggttagtcgtattcgacggcgccccaacgttgcggtaatcaagctgttcatgtaacggcgtaccgaaggaataattgactctcagaccgccctctgcctgcgagccgccgttaccggcgtcccgatatcctgctctgacctcaagcaaggggacaggattccagaccagagccgcacctgcggcgcggggattccggcttaatgtaccgttacccaatagatcaactttatccccgtaatactgttcatatgtcagctctccactgaaccagggaaaatcggggagcgtgccttttgttcgcagatcaaagccatatgccggacgctcatcatgtaattcatgcgctgctgacattttccagccggtgagagggaaataatagttgccggaaaaggccagactgtctttatagacttccccgccaatgccgccacgcaagtgggaataacggatgtcggcatccagaaacgtattgacgccgagcagccatccattgacctcctggcggtaacccataccaacgttaacataggtgcggccatcgaaactgctgttgtcgtggtcgcgaaagccaagctgaccaaagagtaaagacgatgttgtttcctggacgggaataaacatatcgaactctgatgagcgatatttcgcgccatcttcaagattgacgccaccacggaaaataatctccggaaaagcgctctttatcccctcgttcaccagatgattagcggcctgccctggtaacgcctttatttttcctttggcataatcctccagcgtcccctcctgcagatgcggagaaatagacgatgccgtccccgcaatccacgactgaatttcattatcgctatcagcaatgaccggcagtggaatctgactggtaacaatggcccaggttatatatttagtaatgggttttttagaaaaaaccactgtattgtctcctgctatatccccctgcctggcagagggagtatttaaataagatgtttatttggcgataaccatcagcgacggatagcgcgtttattctccggcgtggctttcgtcgttttaggcgtaacgtggacacggaacagtttattctgctcagttcccttaataatatatttatgcttttcagcgttggtattattcagatcggtgaacttatctggtgtcccggcatccgccatctgccaggtaaagttataattactgacctcacactcagccgccgctgtggcggcacattccagtaccgcttcaagggtgccgcctaccactggagtgttggcgtcattggtaccgttgagttcatcagtcggtttaccactttcattcaccacattgatagtgacagaacgtagcttattagaaattgtaccgtctgcggcggagtcgccgctcaccccagaagatgcagaagttaataagacagtggcaggcaagaatgcactatccggcgtccccgttgccgtcttaatccggtaaacgattttaatttttttaccgcctgcatcagcaggaatggtaaaagccgtcccggttgccgccggggttccagaaggatcggcggcctcattatccaccagataccatttaatatcgtcggcattattcattttatccagcgataagggatccccatcctcatccctaataaaaacatccgctatctggagggttgaaccggtcgtcagttccccagacacttctattttttttgcattagtagttgccacaggacggtgaccaacagaagcaggtgtagcagaagaagccatatcattggctctggtattcgccaccgcctctactgagaccacggatgcacaaattgctaacgttaataaagatcttttgaagtacaaaacaattcccttttattaaatcattagaaataattacgagatttataatctcacgggctaaaaattcagggttattcaatcattttaaccgcctgtgaaattatgcccttcgccatgctaattacttagctttactggcaaaatccgatctccaagtgtaaagtttattcagaaacgtcaagcaatttaaatctttcttgttttgccagaaaagctaacaaccccccactggtttaataacacagtatatcaaacaccttaaatgtttatattttcggcttcaataaagaggaatgatgatgaaaaaagccataataatctcagtattagagcaaatagaaaaaaatcttgaagagaggattgatattgaaaagctggttgttataacaggttattcgcgaaggagtttgcaggatttttttaaagaaaagtgtggcgtctctatcggaaaatatatcagacaacgcaagttgagcagaagcgccactctgctaaagctgacctctcagtcggtcacagatatcgcgttcagaatggggtttgattcagtgcagtcctatagtcgagagttcaaaaaaacatttggcgtcaatcccaataactatcgcaaggctgatttctgggatctcagaaacctacggcctccctactggcttgactgtgatgagcattatcagttcgaaatttgtcagcttacgtcaaaagaaattttcggatttcaaacgtctcatcagatcgcaacaaatgaccttcctaaaaaagcgtcgcctataaaatggaaaatcattcatgagacgctcagaacgtggggcgaaaatgtgtattgtctctcgtcttttaagccggataataccaaagaccaggtcatcgccgtaagcagtttttttggtatggaacataattccgtcgatggaggaaaaatacccatgtcgagggtaataaaatgtggtaaatatgcaaaattccattttgttggtcataaggaacaatatcaacaattttccaatacaatatatatgtgtatattaccaaaactgaatcttatcaggagagaaggagaagatattgaatacttccatttggcatccgtccaaaagcaacagaataatgaatccattgtcgatctttattattacatccctgtactgtaatgacttcgtaccatccacgcatttcatctgaaaagtcttctcttttcagaacggtaataaaactctcagtattgattctggtaaaataagtgactattaatatagttaacgttttgaaagaattgaaaaaaataaattgcgtgcacgcgacaccggagacagattactgacagtactgtacggtgtagtgatcaggtaatattggctacagtttacggtaaaagcaaagtccatactttaactattaatgggagtatgctggccgggcggcttgcggggccttcatgctcccacatttacaatgttggtatgattacattctctctatactttactgtgctaaccttttatctcgttgagataacgtttaattaaaatgctctctttttgatgtacattataagaggagacattattcatattttcgaaatcagggcagacgatatgtatacaaccatcagaaacacagcgctagcaatggtagcttgtttttcgtatatcgcacatgccagtacccaccctcctcttattatcaccaggggagccggaggagacgcctccggagccacagtcattcatgataattggcggcatggcactcctgacctggtcaatcttaccgatatccccatagataaaatcagaccagaaaaatacagttgcatactgattattgggcaaggagctataaaagagatgcttcttgcgaacaatgcctcagcaatactttccggaaaaacggttggtctgtatagtcatctgatcgatcagaacacgctcagattacttcggcaattgcagaacaaagtgagattcaatctattttttacccgctcgcagataactctactaaaactaaggaatatttcagaatataattttttgagttctaaagtaaataatgtctggggacaagactcactagcaattgaaacagtggcacctgacaggggtaatataccggaaaaagcgcttcccctcaaaacaacagattatgtgatctggctgggtggaaactatactacttcctctggtacgcagcgtatcttcacaaacgatcagattgttgtagccctgaaaccactacataatgttatttcatcaaatgcatcgattgctattatgctttcaccacgtttttttgataatagcgtgagtaaagaagcaaaagttaaacgactgaaggcagtgcttaacaccttttcgcgaaacagggtcacattttatatgagtaaggagatgcttgctaatctgaaagaatttgatttgccagttcaactatccccttcttacgcagagctgatgcgaatgccctgggccagcgctacccggcattttgcctctgtggatcaatataacctgtttgctgatctcatacctaaagttacgccgtttcttcttgaaccgaatgatgccgatcaagctctctatgcgacggattatcttaatacccggcgtgtaagtctgacccaaaatattcttaaccacggttgtgactaaataaaacgcgcagaatccgggatagttagcaatccaaaacagaccgttagccatgagtactgtttatcttcactatacagggaacaaccaaataactgacaacacaaatcaagccgagacccggaattcggctatacaggcgctctattcaattcaggcccagaaacagtccggtacccatactggacacggcctcccaactgctttagcgcattaccagtccagcttcgatgcgccttctgtcgtctgcactatttcactggttttcataacgcgatgataaccataaacatcagcgtatttcgtcattccggttgcggtgtcaacctccggcttaccctgcgtttcaataatctctcccgtccgggtcgtcatggtataggtcgttgtacatccggctagcatcaacactgataagctaagtaccgtaataagactacatttttgcatttctcgtttccctggcacctctatttttgatgtactttaccgaataccgcaacggcaagatggatgattagggctattgctccctgtttgtccgtatctgactggctcaggttttttgatgcgctgcgttaatccggcagtaatcgctccagcacatccccagccagaagcacgctctcctgaagacgctccaggccataccccgctcgcgccttggcggaaagccccgccattagcgtccccataaagtccgtcgtccggtcagcctcttgcggataccgcatggcgacataagtgcgaatcaggttttcagcagcgatgtaaaactcgcaggcggcctctcgtgccggtttatcgttacaatgagcgccctccagaaccagacacccagtggcatcaggatcggcagcgtaacgtcttgccgcttccatcagcacatcgataaggcacttcgcggtcgggcgatcgtgacgcagaagcgccccgagcggaatcgcgtcggtcatcctgtaacgctttaatacgcgagtatacagccccaacttgctaccaaacgccgcatagaaactgggaggattgatcccgaacgcttttgtcagatccgctacgctcaccgcgtcgtagccgcgcgaatgaaataaatgttgagcggtttcaatggcttgctccggatcgaactggcgagggcgacccggcgttcggctatgttttgtagtcattactacataactccttgacggcatgatttcattacgcatattgtagtggctactacaatatcataaaggacatcctgatgacgctatttcgcaacaaatctgtactggttttagggggaagtcgtggtatcggcgcggctattgtacgacgctttagcgctgacggcgcatcggtcgttttcagctacgccggatcgcgtgaagccgccgaaaaactggcaacggaaaccggaagcatcgccatccagacggatagcgccgatcgtgatgccgtcatcagcctcgtgcgtgagtacggaccgctggatattctggtcgtcaatgcgggcgtcgctctcttcggcgatgcgctggaacaagatagcgatgcgatagatcgtttgttccgtattaatatccatgcgccttaccatgcgtcagtcgaagcagcccgcaacatgccggaaggtggacgcattattattatcggttccgtgaatggcgatcggatgcccgtaccgggaatggccgcgtacgccgccagtaaatcagccctgcaagggctggcgcgcggcctggcccgtgattttggcccccgcgggattacgataaatgtggtgcagccaggcccgattgataccgacatcaatccggaagatggccccatgaaagagctgatgcacagtttcatggcgatcaaacgacacggaagacctgaagaagtggctggaatggtggcatggcttgccggtccggaagcctctttcgtcaccggcgcgatgcacaccatcgatggtgccttcggcgcctgacggccaggcgaatatcacacggttgccgtctacgctccggcaaccgtgttagaagctgttcatgcgagaaaacatccgcaagcgccgggatcaatcgtggattttaacgccaagacaaccgcgaacaaattcaggattaaaatgcttcaccgcttcgccaacgtagcctaaatcaagggcgttgatttgagccatttcgttatccgttagtgagaaatcccagatagcaaagttctcttcaatacgttcctgtcgagtggatttaggaataaccgtgacgccacgctgcacgttccaacgcaggacaacctgcgcgatggttttttgatgggcatcggcaatcccttgaagcatgacattttcatacggtttatgtctcccgccgcctaacggcgcccacgcttcaggctgaacgttataatgcttcatggtttccagcgcggcgggttgtgcaaagtatggatgcaattcgacctggtttaccattggcgtaattctgacggtttcacagaagttggctaacacatgcgcatagaagttggacacgccaatggcttttagtttaccggcttcataagcgtcctccagcgcgcgccacgcgctaaaataatcacccattgcctgatgcaataaatagagatcaaaataatctaacccggattttttcagcgacgcttcaatacctgctttggccagatcgtagttagccatatcttgcacccacagtttagaagtaataaataactcctcacgggtacacagacctgtcgcgatggcttcacgaacagcgtcaccaacggcatcttcattgccgtataccgcagcggtatcgataagacgataaccgctgcgaatagcgcttaacactgactgctgacattcttctttgtcggttaccttaaaaacgccaaaaccaaccataggcattttaaggttgttacttaatattgaatattccacgctaaagcaccctttcgtcgtaaagacgccatgataagagcaaaatacaggtacaatgagtattgttaaatacgattatatttatacaaaaagttcattaataacagttgtacagattttttattgcatctaaacgttcagtgcttgctatatcctcgccgtgtagcacctgtttgataatgacttttcttatgcgtcaaaaccagtaccgtcattttgaccgtctgtgaaaaagttttctgaacaggcaatgcgatatccggaataatatttttagcgaagaggcgccggctggctcagcgccgttttgcaccagtcataaaaagcgcgtaccgcaggcggcagaaacctgttttgcggatagaccagcgcaagcggcaaatcataagaatggttgtccatgcaggtcaccagcgccccgctgtgcagatacggcgcaaccagatagctggcgacgcgaattaaccccagtccctgtattccggcctgaatataagcgtccgtatcatcgacaaccagcgtctcctgcacccgtatcgcgtaatccttcccttcacgcgtaaaaaaccagtcgatggtacgcccggtgcggtggttcaggtagccgaccgcatggtgcttttgcagatcatctaaattttcagggctaccgtaacgctcaatgtaagtgggcgatgctgctatcacccagttaaagctggcaagtggacgggcaaccagcgtggtggaatcatcgatcctgccggcccgaatcacgcagtcatacccttgaaggataatatcctccacgctatcgctggaacaaagtatcagctccagctccggatactggcgcaaaaaggccgggagcgtgggaataatgcaatgtcgggcgagagattgcggcatccccactttaaaacgccctttgggttgtgccgcccggccgggaaatgacgactccatggccgcgatatctgccagcactcttttgcactcttcgtagtaacgccgcccctctgcggtcacactaagtttgcgagttgtacgttgcaaaagttgaatcttaagccaggattccagttctttaaccactcgcgataccgttgagcgcggcacgcccagcacttcggcggctctgataaaactatgggtatccactacgcaaacatagacctgcatcgcttccagcttgtccattttccccccgccaattatcccatttatcagaacagtctaacccgtcttcggcgtcttatcgaacgcagatccctgacgtaatctctatctacaggtgaatcaacacagagaggcgcaaatgaaacaatccaataatcaggtgggtgaaaaagtattggtgctgggcgcgggacaactgggggcgtcagtgctggcgtcgttggttccggcggtcacacagcgtaatggttccgttagcgttattgtgtcagggcgatccagggataaacagagcaaacgacgttccagcattcatcaacaactggcagatgccggtgcgcggtttatcccggtcgacatcgcaggcagttcggttgcagcgttaaaagatcaattccacggttttgatacgatcatcaattgtatggggtttgtcgccggtgcgggtacccagataaaaatcacccgcgcggtactggaggcgggcgttaagcgctatttcccctggcagtttggcgtgaattacgatgtggtcggcaaaggcagtggccagccggtgtgggacgaacagtatgacgtcaggacgcttttgcgcgagcaaaacgtcacagagtgggtgattgtttcaactggtatatttacctcttttctcttcgaaccagcctttggtgtggtcaacttagccaaaaaaaccatcaatgccctcggcggatgggaaatgcaggtcaccgtcacgtcgcctgcggatattggtcgcctgaccactgaaatttatctgcatcagccgcgtatcactaacgaagtcgtctttgtcgcgggggaaacgacctcttatgcaaaactggcggaaacggtcgaacgcgtgacgcagcaaacttttacccgaggcgtattgacgctacctgacttacaggagcaactccgtttacatccgcatgacccaatgctgcgctatcgcgtcgccttcgcgcgtggtgacggtatgtggtggccgatgagtgacacctggaatgcacaacatcatctgccgacacaggatattgccgcctggctgaaaacacagcaatgagaacggcggcatcaggcgctcgcttaatccccatgccttctgccagcatcaggcggcgggcgtggctaccttgcgttaacaagaaaccagtacgcatcagtgcttcacgatatacattgtacggctataggccacatcttccgggttagtaatggggtatccctttacccacggtttaattaaccggccattggtatactgataaataggcgctataggcgcttgttccgttaaaattttctccgctgcattgtaatccgcgttacgcgcttcggcagtattttccatcgtcgcttgcgtcaggattttgtcataagtcggattagtaaagcgtgaaatattccccgtatgcgtggacgttaataaggataagaaagtcgacggttcgttgtaatcacccacccaggaggcgcgaataacatcaaaattaccggtattccggctgtcgatatacgttttccactcctggttttgcaatttcacatccacccccagatttttcttccacattgacgccaccgcaatcgcgattttctgatggttttctgaggtattgtaaagcagggttaatttaagcggcttctgcgatccgtagcctgctgcacgcagcaatgttttcgcctgggcattaagttcttcctggctcatttgttcaaacggtgaaggatcgggcgtaaatcctgccgtgacatccggtgtaaaatgccaggccggtttttcaccggtacctaagactttttccgccatcaaacggcgatcaatggtcatacttagcgccagacgaacgcgggaatccgccgtcggccctttctgcgtattaaacgcataataataagtccctaattgcggcggtgtataaacttgccctggaatatccttcaataatttctggtacatatttttagggaaagattcggtgatatcaatatcaccggcaaggtaacgtttcgtcgcagccgattcctggttaatgggtaaaaatgttactttttgcagtaccgttttcgcgttatcccagtaatgcgtattaggcacgaccaccagtttttcatttaccacgcgctctttaagaacatacgcgccattgccaatcagttttcccggcttcatccagtctttgccgctttcaacattcgctttttggaccggataaaaggcaaaactggcggtcagactggcaaaccagggcaacggcttgtcaagctgaacacgcaaagtgtgcgcgtccacggcactgacgccaagctgatccggcgtgactttaccgtcgataatggcttgtgcattagtgatgccagccagagcggcaaaccaggcgaagggggaaagcgttttgggatcaacgaggcgttgccagctatagacaaaatcctgggcggtcaccggcgttccatcggcccattgcgcatcatcccgcaacgtaaacgtccagatacgattatcattgctcttccactggctggcgacgccagggataatttcacccttttcgttctggttaaccagcccttcaaacagatcgcggatcacctgaatttcaggcagcccaacggctttcgctggatctaacgaagcgggctcatctttgatatgacgcaccagttcttgtttttctgccagtaccgttccgccgggaacatccgcagcatatgccagggaaaagctgctaaccaacagcgcacaacaggttactgaaacagaatgcctcatagaagttcctcaaagatgagttaaatgacaacgtaattatttgtttcagcagaaagaaatgcaattatcttccgccagaaagttgatatcgcgccatacaagagggtaaatagaaaccatttgataatcggcgggttttacacaacactacgatgattaccctactggtctcagcttcgggaaacgcgtatgactgtcacccgcccccgtgccgagcgcggcgcatttccgccaggcactgaacattatggacgttcgctactaggcgcgccgctaatctggtttccggcgcctgccgtcaatcgcgaaagcggcctgatactggctggcacccacggggatgaaacctcatccgtggtgacgctctcctgtgcgttacgcaccttaaatccaacccttcgccgtcatcatgtcgtacttgccgttaatcctgatggctgtcaactggggttaagggcaaatgcgaatggcattgatctaaaccgtaactttcccgccgccaactggaaagcgggtgagacagtttatcgctggaatagccgcgcgcaagagcgtgatgtcgtgctgctaaccggcgaccatcccggctcagaaccggaaacccaggcgctttgccagttaattcatcgactccaacccgcctgggtcgtctcttttcacgatccgctagcctgcattgaagatccacgtcgcagcgagctaggcgagtggctggccgatgcgtttgcgttgccgctggtgaccagcgtaggttacgaaacgcccggttcgtttggcagctggtgcgccgacctcaacctgcactgcattaccgccgagtttccccctgtttccgccgatgaagccagcgaaaaatacttgctggcgatgtcgaatctgctccgctggcatcctaaagatggagttgacccgtcgtaaagcgtagcgcgggctcaacatcaaccgccagccatgttgggccatcaagatcggcgaagctcacctgcggcataagcggcagcgcggcgctaatcgctcttgatgtacagagcatacagcccagcatcaggccgaatccttgctcccgcgcctccgttgccagcgccagcgcctcggtcagaccgccggttttatccagcttaatgttgatcatatcgtagcgccccgtcagggctttcagactactgcgagtatggcagctctcatctgcacagatgggcaacggatgaataaaattttccagggcggcgtcatcctgcgcgggcagcggttgctccagcatcgcgacattcagatccgccagtaactggcaacgcgccgccagcccctccggacgccacgattcattggcgtccacaatgagcgtcgcctccggcaccgccgagcggatcgccaccatacgttcgctaatcaaacgagcatcgagtttaattttcagcaacgtcgcccctttttcccatagtgccgccgcactggctgccatctgttccggcgtgcctatcactaccgtttgcgcggtagtaaaaaccggggccagcgtcacgccgagcagcccggcaaggctttgctgccgctggcgggcttgcaaatcccataaggcgctatccaccgcgttgcgcgccgcgcctgccggcaacagtttctgcaatgcttcgcgagtcagcccgttttccaactgaggcacaatactcatgatttgcgccatgaccgaggcatcactttcaccataacgtggatatggcgtacattccccgatgcctttcacgtcctcttcttccagttcgacaacgacaacatgcgcttcgcttcggctaccacgcgcaataacaaaaggcgtatgtaacggccaggtttcctcatataccttaacagatctcatctcttcccctctgatagcgccggacgcggcttgctacaaatagtatttgccgtgttaatgaataatgacttaaactggatttcgacgttaactataagtaaataggaacataattatgtcacagactgtacatttccagggtaacccggtcaccgttgccaacgttattccgcaggctggtagcaaagcacaggcttttactcttgtcgcaaaagatttgtctgacgtttccctcagccaatatgcaggcaaacgcaaagtgctgaatattttcccaagcattgatactggcgtatgcgccgcatcagttcgtaagtttaatcaactggccacagaagtggagaataccgtcgtattgtgcgtttctgctgacctgccttttgcacagtcgcgtttttgcggcgcggaaggcctgagcaacgttattacgctttccactctgcgtaataacgagtttctgaaaaactacggcgtcgaaatcgttgacggcccgctgaaaggtttggcggcgcgcgcagtcatcgtgcttgacgaaaacgacaacgttattttcagccagttggtggatgaaatcacccacgagccggattacgacgccgcgcttaatgtcctgaaggcataagccagcgcctgctggcgctacgtttgtcagtgctacaggcggtgctcttttgtcacaagaaggcctctatccggaggccttcttgttttctactcttcacccttcttctggctcagaccatattcacgcagcttattggcaatcgcggtatgcgatacccccaaccgtttcgccagtttacgcgtactcggatagctacgataaagctgggtcaggacagaacgttcaaaacgactggtaatgtcatccagcgagccttccatcgcatcctcgccgactgccaccgtcgcggcatcgtagtcaggcagcaggatatcctgcggacgcagctcatacccttccagttgcgtcagcgcccggtaaatcgcatttttaagctggcgaacgttacccggccagccgtaacgagtgaggaccgtactcagatcggcagacagtttcggtcgcggaacgccctgttcgtcggcaaaacgcgccacgaacagttcggtcaacggcataatatcctgcggacaatcgcgcaacggcggcaaattaagcgtcagaacgttaagtcgataatagagatcttcgcggaacagtcctttttgcaccagctccaccagatttttctgcgtggcgcagataacacggacatcaacatgaatttcgtgatcttcgccgacgcgacggaacgtaccatcgttgagaaaacgcagcagcttcgcctgcatacgcggcgacatttcgccaatttcatccagcagcaccgaaccgccattcgcctgttcaaagaaaccttttttaccttccggcgcatggccaaatagttcgctttctaccgcatcttccgggatcgaagcgcagttgagcgccagatacggtttcgctgaacgagggcttgcctggtgacaggcataggcgaaaagatctttgccggttcccgtatcgccggtaatcagcagcggcgcgctgagcatcgccagtttgcgcgcctgctcaacgacgtgcttcatctttgcgctcacggcaataatctgactaaacgcgctcagatcctgcgtggacaaattctgtagctgctgccccatacgaatcgtggaacgcaacatcacgaccgccccggtcaacacgtattcgtcattttcgttttgtaaatgtaccggcgtaatctccatcaggaagttttgcccgttgatcacgacatgttcgttatgggagctttgcgggttaccgtccagccagcgctgaaaattgaagccgttgattaattgtgcggcggtatggtgccgcattcgctcctggctctgggcaaaaagttgacaactcgccgggttcgccatctccactttactcttcatatccaatgagagcaccggctccggcaacgcctcaagcagcgcgctcagggccagatgttcacgttcggacggcatccagggaacggtacggacatccgttacgccggaaatacggcggatttcggccatcaggctgctgaagtcggtgaattccagctcagcaaaattaagataaattcgcccaatgggatcaatctcgattccgcgtaaatcaatgctacgtaacaccagtaaatcaagtaattcgcgggtcagaccaagtcggtcttcacaaaagacttccagacgcatgggaaccttcacctgaataatgaaccattaaatagatgataagccactattcggctggcaggaaggattctgtcaacaaatattgacagcatggcggaaaaacgggcgctgcggcgtaaagccaggccgtcagcgccatgtgaaaggtcatttctcaggcgacgacttactcttttgcagcgtctcttttagctgaccgataagctgacgacgaaaatcaccgagacgtggtttatcgttatcgatccacggcaatggtcgacatagctccatcgcttttattcccagtcgagcggtaaggagacctgcgccaatcccctgcgccgcacgcgtggacaagcgtgcggccagatcctgagacatccagtccataccgacttcacgcaccagctcactggctcccgcaaacgcgatattcagcaacaccagacggaacagacgaaggcggctgtaataaccaagttcaatgccatacagcgttgcgatgcggttaatcaggcgtaaattacgccaggcaataaacgccatatccaccaacgctaacgggctgacggcgatcatcagagtcgattccgcggcgaaacggctaatctcacgtcgcgcctgcgcgtcaagtaccggctgtaccagattcgcatacaaaccgacgatttccctgtcgttttgcgtttcgtgaatagcggcataccaacgttgtaatgccggatgtgattgatcaatccccgcctgctgcgccagtttttcgcaaaatgcgcgacctttcccgacgctatggctatgtaacagttcacgcgcttcatcgcgttcatgcgcccgctggcgcaagcgccataatcgccgccactccgtgaccaccgatcccacgccagcgccaacgatcagcgcgcctgcggcacagccgcctaaagcgacccagtcctgagtttgccaggcattcattgtccactgtacgccttgcccgaccacgctcgcgccaaacagcgccagtcctcccatcaccattttacgccacaggctgcgtttggggcgcagcgcggcatcgaccgccgcttctgccgcgccttcgtcttccgggcgctcatcgatagctgcaggcgcaaatgtacgcgactccgcttcgctgaaagtttgctgcgctttgaaggccgacgtaggttcctcctttagcggttctgcaaaatcaatacgcggttttaacggttcgctcatcgcagcttatctcctattaaaaactccagcgcagcgtccagacgaatatgcggtaacggtttatcaacatccatcacctgcggacgaaaggcttcgaactgaaaaccctgactatcccaaaacgcttgccccggcaaacgcgaaggcacttcgccggggtacacggttaacggcgcgccgtcactcaaacggtttccacgtaaagccgggattttttcgccgttgacctcaatcacaccgctggtggtcgcctgtaccgacgccagccccaggcaatccatactaatgccttcaaacgcggcattttgccaggcatcctgaataagctgctggagcaaggccaccatattggcatgttggtcgagggtgacatggtcggctttcgtcgcggcgaacagcaatttatcaatcaccggcgaaaacaaacgacgaaacagagtccgctggccatagtgaaaactttgcatcagctgcgttaaggcgagacgcatatcattaaacgcctgcggcccgctattaagcggttgcagacagtcgaccagcacaatctggcgatcaaagcgtagaaaatgatttttgtagaaccctttgaccactttttcgcaatagtagttaaagcgttcgcgcagcattccagcgttggtctgtttatccgcctgcgccagttttgactcgccgaaggcgtccacatccggccacgggaaaaactgcaatgctggcgcgcccgccatatcgcccggcaaaacaaaccgtccaggctgaataaaatgcaatccctgcgatttacactgatgcaaataatccgtccaggcggcggcaatctccgccagccggttttcatcggcgggcgccagcggatcgagcccgtcgcaaagttgccgccattttgcggcccactcagcgcgttgtccttgtaacaagccgttcatctgacgggaccagcttaaataatcctgagccagcatgggcagatcgagtaaccattcccctgggtagtccacaatctccagatacaatgtcgaggtatctttaaaatggcgcagcagcgagtcgttggagcgatagcgcaacgccagccgaatctcactgacgccgcgcgtcggtgtgggccaggcgggaggattgccataaagctgaagtatcccctcgtcgtaggtaaaacggggaataccaaaatcacgttgaggcacacgctttacgccaagcaggcgttcttcgcgtaccgcgctgagcaacggtaagcgcgcgcccgcgtggacattaagcaactggttaaccatcgccgtaataaacgccgttttaccgctgcggctcaacccggttacggcaagacgcaaatgcctgtctaccccacgattgaccagcgcgttgaattcagttttaagtcgcttcattgacatcctgttgagcctgaagagaagaaaaaataataatgagcctgcgttatagatatgtgcaaaaacgttattatcaactacccggagagatcaacaacggcgcattaagcgccgcggttagtatgagtattgagcaatagattatctatttttttactttcggcatatcaagacgactgataccgcccatattcatcgcgtgcgtataccccatatcaagcaacatttgttttgccatgcccgactgtcgcccggagttgcaatataactttaccgtatcgttcctgtctggaactaccgtttcgatatgagatttaatctccttcaatgggatattaatcgcgccctgaatatgctctcgctgatattgttccggaatgcggacatctatccagtattctgcggcataaagcggcatggctatgaataacgctaacgcaaatattccttttttcaacatacttccgtcctgacacgtaatgtatttcgcacacactatacgccagagcttaacgaaatattatgaccagactcgctatttgtaacgctgcgaaattttattcgccgccttacgaagtactggctccagcgcaaacgccagcaacatttttagcggacgacgggcgacggattttaccgcccatcccgccacgccggcaggcccgtagcgtaacgcggtcaacagaaccagcttacctgctattttgaagccgggcttcaccttctgcccggcgcgttgccagcgagtattcatcttcaccttcccgatatatcacttacagttgacggaaacgactacgcagtgtgaacgtatctgacgtgacgtagcgttccatttctcgcaaacgcttttcgcctgcggcaagctctctgtctacggtatccagcagttcgccgctggtcggctgcggtttgcctgcggccagattatccggcatagggtccagtacaaaagacagaacgatataggccactacggtaaaaaacgccagcccaaagaaaatcgacagcacgaccagaatacgcaccagttttaccggtacatcaaggtagtcggcgatcccggcgcaaacgccacgcaccatgcccttttgcggcatacgccatagttttttattcagattgattccacccattagcgctctctccagttcggatgctctgcatcaagaatgtcttccagcgcctgaatgcgctcgcgcatacgttgcgcatcgtctgtgagttgcagtaagcgttgctgctcgctttgcgacagttctccccgaccggcgcggttgctgtaatgcagccacagccaaatcggtaacacaaacaacacaaaaatggttaacgggatggccagaaatagcgcgctcatgcgttctccttacacctaaagctgatgagcgacggcgcgtatcggcgccgccattgtcattattgattatcttgcttcattttggctttcaactgcgccagctgctcgctgatttcatcatcggctttcaggttggcaaactgttggtccagcgattgctgcttaccaaaacgatggctttccgcttccgcttccatttgatcgatacgacgttcaaaggattcaaaccgcgccatggcttcatccagtttgccgctgtcaagctgacgacggacatcgcgggaagaactcgccgcctgatgacgcagcatcagcgcctgctggcgagcgcgtgtttcgctgagtttgttttccagctcgccaatctctttcttcatgcgcgccagcgtgtcatccaccagcgtgacttcctgttcaagcgtagcaattaaatcggtcagcttttgtttttcaatcaatgcggcgcgcgccagatcgtctttatctttgcgcagggccagttccgctttttcctgccactcgatctgctgagccgtagcctgttcaatacgacgggataactgtttcttttccgctaaagctcgcgcggagttcgagcgaacctccaccagcgtatcttccatctcctgaatcatcaggcgcaccagcttctgcggatcttccgctttttccaacaacgcattgatattggcgttcacgatgtcggcaaaacgagaaaaaatacccataattcaatcctcacataatgttctgataacgggcgatgccctgctatgtgattaatacaatttgcgtgccaacttttcataccactgataataaagaaattgtttcgttttacctcgccagcaaaaaaggataaagtggtgaaaaacactaacaagtggcgattttcatcatggctgaatttaaagataacctgctcggcgaggcaaaccgttttcttgaagtactggaacaagtctcccggctcgcgccgctggataagccagtgctgattattggcgaacgcgggacgggtaaagaacttatcgccaatcgactgcattatctctcttcacgctggcaggggccgcttatctcgcttaactgcgcggcgcttaacgaaaatctgctggactccgaactgtttggccatgaagcgggcgcttttaccggggcgcaaaaacgtcatcccggtcgctttgaacgcgccgatggcggcacgctgtttttggatgaactggcgacagcgccgatgctggtacaggaaaagctgctgcgggtgattgaatatggcgagctagagcgcgtcggcggcagccagccgttacaggttaatgtgcgattagtatgcgccactaatgccgatttacccgccatggtgaaggaagggacatttcgtgccgatctgctcgacaggctggcttttgatgttgtacaactgccgccgctgcgcgaacgccagagcgatatcatgctgatggccgagcactttgctattcagatgtgtcgtgagctacgtctgcccttatttcccggttttaccgatcgggcaaaagaaacgttgttgcattacgcctggccaggtaatgtccgcgagctgaaaaacgtagtcgaacgttcagtgtatcgccacggcagtagtgaacaacctttggatgaaattgttatcgatccttttcaacgccatcccgctgaaccgcccgcgcccgccctgccagcggcatccgtcacgcctgacctgccgctcaaattacgtgagtttcaactgcaacaggaaaaagcgctgctgcaacgtagcttacagcaggcgaagtttaaccagaaacgagccgccgatttgctggcgctcacctaccaccagtttcgcgccttgcttaaaaagcatcagctttagctatttctccggctaattgacgacatttacgccagttatccaccgacatttttacgtggcgggccgaagtgcgatacactttgcaaattgaacttcaaaaacttaactattatgcgcctggttttatcgtctctgatcgtgatagcgggtctactaagtagtcaggctacggctgcgactgcgcccgaacaaactgcgagtgcagatattcgcgatagcggctttgtgtattgtgtcagcgggcaggtcaacacctttaatccgcaaaaagcgagcagcggcctcatcgtcgataccctggccgcccagttatatgatcgcctgttggatgtcgatccctatacttatcgtttagtcccagagctggcagaaagctgggaagtgctggataacggggcaacgtaccgttttcacctgcgccgcgacgtttcctttcaaaaaaccgcctggtttacgccgacccgaaaactcaatgctgatgatgtcgtctttacctttcagcggattttcgatcgtcgacatccgtggcataacatcaacggcagtagcttcccctactttgatagcctacagttcgccgacaatgtaaaaagcgtgcgtaagctggacaataacaccgttgagtttcgcctgacgcagccagacgcctcctttttatggcatctggctacacactacgcttccgtcatgtccgctgagtacgccgcgcagcttagccgaaaagatcgtcaggaactgctagaccgccaaccggtcggtaccgggcctttccagctttcggagtaccgtgccgggcagtttattcgtctccagcgccacgatgggttttggcgcggcaaaccgctgatgccgcaagtggtggtggatttaggctccggcggtaccgggcgtttatcgaaattactgaccggtgaatgcgatgttctggcctggcccgccgccagccagctaactattttacgcgacgatccgcgtttacgtctgacgttgcgcccggggatgaatatcgcctatctggcctttaacaccgataagccgccgttgaataatcccgcagtgcgccatgcgctggccttatcgatcaacaaccagcgcctgatgcagtcgatttattacggcacggcggaaaccgcagcctccattttaccgagagcctcatgggcttacgataacgatgccaaaattacggagtacaatccgcaaaaatcgcgcgaacagctaaaagcgctgggcattgagaatcttacgctgcatctctgggtgccgaccagttctcaggcctggaacccaagtccgctaaaaacggcggagcttattcaggcggatatggcgcaggttggcgtaaaagtggtcattgtgccggttgaaggtcgttttcaggaggcgcgcctgatggatatgaatcacgatctgaccttatccggctgggccacggacagcaacgatccggatagctttttcagaccgctgttaagctgtgcggccatcaattcgcaaaccaatttcgcccactggtgtaaccctgaatttgacagcgtgctgcgtaaggcactgtcgtcgcagcagttggcttcgcgcatagaagcgtatgaggaagcgcagaatatcctggagaaagagctgccgatactgccgctggcatcatcactacgcctgcaggcttaccgctacgatattaaagggctggtgttaagcccgttcggcaatgcgtcttttgccggcgtctcccgcgaaaaacacgaagaggtgaaaaaaccatgattatcttcaccctgcgtcggttattgctgttgctggtgacgctcttcttcctgacctttatcggctttagcctgagctattttacgccgcatgcgccgctacaaggcgcatcattatggaatgcctgggttttctggttcaacggtctgctgcactgggactttggcgtgtccagcattaacggccagctgatctccgaacagcttaaagaggtgtttcccgccacgatggagctgtgcattctcgcctttggttttgcgctgatggtcggcatcccggtcgggatgctggcgggcgtgacgcgtagcaaatggccggatcgttttatcagcgcgctggcactattaggtttctcaattccggttttctggctggcgcttctgctcacactgttcttttcgctcacgctggggtggctgccggtatccgggcgatttgacctgctttatgaagttaaaccggttaccggtttcgccatcattgacgcctggatttcagattcgccatggcgtgatgaaatggtgatgagcgccatacggcatatggttttaccggtgctcacgctctccgtcgcgccgaccacagaagtgatccgcctgatgcgaatcagcactattgaggtctacgatcagaactacgttaaagcggcggccacgcgcggcttatcgcgctttacgattttacgccgtcacgtgttgcataatgcgctgccgccggtcattccccgtcttggtctgcagttttcaaccatgttaacgctggcgatgattaccgaaatggttttcagctggcctgggctgggacgatggttaattcacgccattcgtcagcaggactatgccgctatttccgctggcgtgatggtcattgggtcgctggttattgtggtcaatgtgatttccgatattttgggtgctatggctaaccctctgaaacataaggaatggtatgccttacgatagcgtatacagcgaaaagcgcccgccaggcaccctgcgcactgcctggcgtaaattttatagcgacgcgcctgcgatggtgggtctgtatggatgcgccggtctggcgttgctgtgtatttttggcggctggatcgcgccctatggtatcgatcagcaatttctgggctatcagctactgccaccctcctggtcacgctatggcgaagtctccttttttctggggactgacgatctggggcgcgatgtgctgagccgcctgttaagcggcgcggcgcccacggtcggcggcgcgtttatcgtaacgctggcggctacgctatgtggattagtcctcggcgtagtggcaggcgcgacgcacggtttacgctctgccgtgctgaaccatattctggacacgctgctttccatcccttcgctcttgctggcgattatcgtcgtggcatttgccggcccacatctgtcacacgcgatgtttgccgtctggctggccctgttgccgcgaatggtacgttccgtctacagcatggtgcatgatgaactggaaaaagagtacgtcattgccgcccgtctggatggcgcgacaacgctgaatattctgtggttcgccattttaccgaatattaccgccggtctggtcaccgaaattacccgggcgctgtcgatggcgattctggacatcgccgcgctgggatttttagatctcggcgcgcagcttccctctcctgaatggggcgccatgttgggggatgcgctggagctaatctatgtcgcgccgtggaccgttatgctacccggcgcggcgataacgctcagtgttttactggtaaacctgctcggagatgggattcgtcgtgcgattattgcgggggtggaataatgccgttactggatatccgcaatctcaccattgaatttaaaaccagcgaaggttgggtaaaagcggtcgatcgcgtcagtatgacattaagcgaaggtgaaattcgcggcctggtaggtgaatcgggttccggaaagagcttgattgctaaagctatttgcggcgtcgcgaaagacaactggcgagtcactgccgaccgtatgcgttttgatgatatcgatctgctgcgcctctcctcacgtgaacggcgtaagctggtcggacataatgtgtcgatgatcttccaggagccgcagtcgtgccttgatccttccgaacgcgtcggccgccagttaatgcaaaatattcccgcctggacctataaaggccgctggtggcagcgtttaggctggcgtaaacggcgtgcaattgaattactgcaccgggtgggaattaaagatcataaagacgcgatgcgcagttttccctatgaactgaccgatggtgagtgtcagaaagttatgatcgctatcgcgctggcgaatcaaccgcgactcctgatcgctgatgaacccaccaactcaatggaaccaacgacgcaggcgcaaatttttcgcctgctgacccgactgaatcaaaacagtaataccaccattctgttgattagccacgacctgcaaatgctgagtcagtgggctgataaaatcaacgttttatactgcggccagacggtagaaaccgcgccaagtaaagatctggtgacgatgccacatcatccttatacgcaggcgcttatccgcgcgattccggattttggcagcgcgatgccgcataaaagccgtctgaatacgctgccaggcgcgatcccgctactggagcagttaccgataggttgtcgtctggggccacgctgcccttacgcgcaacgagaatgcattatcacgccacgcttaaccggcgcgaaaaatcatctctatgcctgtcattttccgctgaatatggagagagagtgatatggtggaaactctgcttgaagtgcgcaacctgagtaaaacctttcgctaccggacaggatggtttcgtcgccagaccgtcgacgccgtgaaaccattaagctttacgcttcgtgagcgtcagaccctggccattatcggcgaaaacggttccggcaaatccacgctggcgaagatgctggccggcatgattgaacccaccagcggcgagcttcttattgacgatcatcccctgcattacggcgactattcgtttcgaagccaacgtattcgaatgatttttcaggacccctcaacgtcactgaatccacgtcaacgtatttcgcagatccttgacttccccctgcgccttaataccgatctggagccggaacagcggcgcaaacagattgtcgagacgatgcgtatggtggggctattgcccgatcacgtaagctactacccgcatatgctggcgccggggcagaaacagcgtctgggcctggcccgcgcgctgattttacgccctaaagtcattatcgcggacgaagcgctggcttcgcttgatatgtccatgcgctcgcagctcatcaatctgatgcttgaattgcaggaaaagcaaggcatctcctatatctatgtcacgcagcatatcggcatgatgaagcatattagcgatcaggtattagtgatgcatcagggggaagtggttgaacgcggcagcaccgccgatgtgctcgcctctccgctacatgagcttacccgccgtttaatcgcaggccattttggcgaggcgctgaccgctgacgcatggcgaaaggatcgctaagcgaaacaaataccctcagttcgattctctgagggtgttcatgcgactgcccaacagcaatgtttcaacctcttctaacgcaacggaaggaaataacgtgccctgggttgcccaaatgcctgccgtttttaacaccggcaaatagcgtgtgttttcctggccccccaccacgatcttgtcacaataacgcgccggatatgtttgacaagcagcggaaacgtcattttttcaatttgtgagacaaaaaagctgcgatcaagttttacgccgctaaaacacccgcaaactaatggcgcagcagttgcattccctacgcccaggtcgcccagccataatggattaggttgcttatgaagcgcgtgtattaaaggatcgattaaggcgttatcttgacatgaaaaatgttcagcgacctgcagctccacaaatagcatggcgtgtagtaatgcgcgaatatctttatcctgaaggacaagctgcgccataccccgatcaatatttacgatacagaataggccgtggcgtagaaaccagccatgtttggccgcgattgtccgcaacagatcaagcagaaaacggcgcttctgcgaattgtcccatgacgagataacaaactcaggatgtagcggacgagcgggcgacgatgcaaaatgggtagtgatttcgacacccagtaaatccccctccattgcccttatcggctctgccataaaaaaatagcgcatgtgaccactccacttgatcttaactccctgataatgcgcttttaacgcaaatcaatcaataaaaacgatcaatatataaaaaatgatcgaaaaaacaatatatgttaacttcatgataacttgctaattttatgttttgagaatgttcttctattgctataaggaaatttacatactacgccgaacaacgctaatacgacggcatgagaccatccgtaaagccaggtttttcttgtcaggcagaggggaaaaatcaaggcgagttaatgttgttacaccattgcgaggcatttcacccactatggcagcgcggcatcgccaaccctagtggcgagttgcatctccgctacaggctgtccagatcccccgaacgacctttaagcgaatagcaactctcaataattgatcggtaaatctgtagcgaatgtgcccccggcgattcgcagaaaagaacggaactaaatgctatttttttaattcatcctttaataccttagccacaagagtcccttcctccggcgcggctagtttaaaacgtcttcctggcgcaggtgtctgttcttcctctccgattaacgcatcaagatccgtaataagtgacttataatattcaacatcttcagtatttccttcggtctcggcccgctttaattttatcatgtgatgggccttaatttgctcttccagttgccttgttgcaagagaaacgcttcgctgttgccgtgattcttgtgataacacgatttgatcgccatccacaaagaaaagaaccccctctttaaccagaatattacctaagatatttatatcatgcatataaaccccccgggatttaagaagcgcctccgccattcgatagttatcttcatcttcaacatcgaactcctgaccttgaatatattttgaaactaaaaccgtaacgtctttaccattaatattcatgatggccgaacgagaaaaattcttgtcgtcattggccatattcaaatacttactgacacgatcaggatgacaattacgatgctccggagagttaacatccacttttattccccgctcattaactggaatcttaacaacaaagtcatcatgtaaccgatagactgtcccataacttccgctacctattttatttttttcaatatcacgcatgcgaatatttttctgaaactccggcgagttaataaacgcctctattgccgctggttgtgatgcatccgtctgatcaatagcgccgctctcataaccagacgccgtggcgggcgtggtcaggaagtctatcaaacgttgctcaaaagcctcatagattccattactacctgcctcgctcggcggtagattatcattacccaaagcggcaagcgtaatttccccgttattataattaaacatcgtttcttttaaaaaatcgacgcaacgttcagaacactccgtctcggtcactaatactccatcgtaaaacatctgtagtagtaacatattttcttgatgtgctaatacctctacagtgtatttatctattgtttcaggtctggaggcatcaataagtttaatatatccaagaagggggcgccatcgtgtacagtcttcatctcgcttcgaaaatggtcctggagagaaaggccctttaatatcgggatgctcttttttttggcacagtagattatagatttctctataatcagaaattaaacttcgcctggtaaatatattcctgaaaaaatctataaatttctcacacgttgaaaaaacatgttctcttttattatcgatgatatctcttaaatacctttctgatatctggcaactatgatttccgatctgaaatgtaaacggcatatgtctcatcctctgaaaatttattataatacacatgcaaacatataaaaacctgatttgtaactactgtaaccacctgatttccaaaatttttcatattcagtattactctgcatcaataaatagagaaaaccttcagcacctaaaaaagaaattatttttgttaagcatttgctggttaaagttacatgtccataacatcgctaataggtgaggtaaaccatttggatgaatattcaggcttcctacagaacctttatttgtctggtggaaagcgcatcgctatcgtacttgctatccgtcccggtgtctctggttggatgaggcgaaccttacaccagctggtatactgcaccgtagggcctgtcccattagactctttgatttgccagtttggccctggggagtgctcaaaatcctcagggacttcgttaccgtgtggttttagaacgtcacctgccggagatagcggcggaaaaatagcgtgacacacggggccaggagtgggatataatttcagactaatttcgaataatgttgaaaagttgctgttaaccattgttcgtaaaagcaaaaaataagcaatgactataaggattaaagctatgggttttctttccggtaagcgcattctggtcactggcgtggccagtaaactgtccatcgcctacggtatcgcacaggcgatgcaccgcgaaggagctgaactggcgttcacctaccagaacgacaaactgaaaggccgcgtagaagaatttgctgcccagctgggttccagcatcgttttaccgtgtgatgtcgctgaagatgccagcattgacgctatgtttgcggagctgggtaacgtttggccgaaatttgacggttttgtacactcgatcggtttcgcgcctggcgatcagctggacggcgattatgttaatgcggttacccgcgaaggctttaaagtcgctcacgatattagctcttacagctttgttgccatggcgaaagcctgccgcaccatgctgaatccgggttctgcgctgttgaccttgtcttatctgggagcggagcgcgccatcccgaactacaatgtcatgggtctggcgaaagcctctctggaagccaacgtgcgttatatggcaaacgctatgggaccggaaggggttcgcgtcaacgccatctctgcgggtccaatccgcacgctggcggcgtccggtattaaagacttccgtaaaatgctggcgcattgtgaagccgttacgccaattcgtcgcaccgtgaccattgaagatgtgggtaactcagcggcgtttctgtgttccgatctctcggcaggcatttctggcgaagtcgtccatgttgacggcgggttcagcattgcggcaatgaatgaactggaactgaagtaagcgcattaagtttattagcgggcggcacggctgtgctgccccattcccctcactcaccactcatctcgttatatagcgttctgatatttgttatcacctaacaatctttcatccctttcccgcatacgccaggataatccagcataaacgatccgacgccgaatcattatcgatcgccatttcatcctcgggaaaccctatggaacaatgccgaaaagcgggtaaaagccactggtatcatgaaacacaatccactatgtcgtcacaaaccccgctttcgctaatgccggaagccgcgtatgttaacgatcgttttttactggatttaacggtagcagaaaccgcgttgacgccttttgagtcatggttaaagcccgctcgccagttggcggatgtcttatttccccgcacggttctcaacgaccggcttcatacgtttagcgcctatgaacgtatgagcaccgcgctgaccgccgctcaggtatttggggttcagcgtttgtgtcgctattatgccgcgcgtctggcgccgctacctggccctgacgcctcaagagagagcaatcaacggctggcgcaaattacgcaatacgctcgtcagcttgccggctccccctccgttatcaatacgcgggcccgcgaacagcttgcagaggtgggattaaccgcccgggataccgtactcatcaatcagatcattgggtttatcggttttcaggcgcgggtagcggcgatatttcaggcgttttgccgtctgcccgtgcgcgaactgcccggccaggagatgcagcgctttgccagggccgcgcggtttcaaaacccccagacgatatggcggcccgccgccagtctggtagaatatcctccagcccataccaaagttcggcggcaatattcgtcttcacaatgccaaatgatggcgccggtactcatgcgcgatccgtcttcattcgcgttactcgaacgcatactgaccagcacattacacactgcatcgcccccttctttacttccacttatcacgctcctcacatcacgtatcaacggcagcgccgcctgctttaacgaacaggcaacccaacctggcgcgtggcgtcgcgctgtcatcacgttacgccaggaagacgacgacatcgctcgttgggaacttgagcctgcgctgacacaggcgatacaatgactcaccagagcgcccgatcgctttagcgccgcgcattttttcccgctactcaccaggggagtttcatcggagcaggccattaatatgttaggctggtgcggcgtgtgcggatggttaaatcgtttaaaaatcgcgttgggcgaaacctattaactcatccattactgaaagagcgcttgctgcgccaggcagaatcgcgtaaaactgtcagccgctcttttggctacgaaaatagacgaatatgtttcaggacaacccgctgctagcgcagcttaaacagcaactgcattcccagacgccgcgcgctgaaggggtcgtaaaagccacggaaaaaggctttggcttccttgaggttgacgcgcaaaaaagctatttcattcctccgccgcagatgaaaaaagtgatgcatggcgatcgtatcgtcgcggtcatccacacggaaaaagaacgtgagtctgccgagccggaagaactgatcgaaccgttcctgacgcgttttgtgggaaaagttcagggtaaaaatgaccgcctgtccatcgtgccggatcatccgttgctgaaagacgcgattccctgccgcgccgcgcgcggcgttcagcatgagttcaaagaaggtgactgggcggttgccgaaatgcgccgccatccgcttaaaggcgaccgttcgttttacgccgatttaacgcagtacatcacctttgccgacgatcactttgttccctggtgggttacgcttgcccgccacaacctggaaaaagaagcgccgaacggcgtagcgacggagatgcttgacgaagggctagagcgtcaggatctgaccgcgctgaatttcgtcactatcgatagcgccagcactgaagatatggatgacgcgctatatgctgaggaattagcggacggcagactccagcttacggtggctatcgccgatcctaccgcctggattgccgaaggcagtaagctggataacacagcgaaaattcgcgccttcaccaactacctgccgggcttcaatattcctatgctgccgcgtgagctgtctgacgatctgtgttcgctgcgcgccaacgaagtgcgtccggcgctcgcctgtcgcatgataatcgccgcggacggcaccattgacgatgatatcgccttttttgcggccaccatcgaatcgaaggccaagctggcgtacgacaatgtctccgactggctggaaaataacggcacctggcagccggataacgaaggcattgcccagcagattcgtctgttgcaccgtatttgtctaagccgcagtgagtggcgtcatcatcatgcgttagtctttaaagaccgcccggattaccgctttgtgcttggcgaaaaaggcgaagtactggatattgtggcggaaccgcgccgtatcgctaaccgtatcgtagaagagtcgatgatcgccgctaacctttgcgccgcgcgcgtactgcgcgataagctcggtttcggtatttacaacgtacatacgggcttcgatcccgcgaatgccgacgcgctggccgcgctgctgaaaacgcatggtctgcatgtcgatgccgaagaggtgctgacgctggaaggcttctgtaaactgcgtcgcgaactggatgcgcagccctccggtttccttgacagccgcattcgtcgcttccagtcttttgcggaaatcagcaccgagccggggccgcatttcggtcttggtcttgaggcttacgccacctggacctctcctatccgtaagtatggcgatatgattaaccatcgcctgctgaaagcggtcatcaagggggaagctattgcgcgtccgcaggaagatatcacccaacaaatggcggaacgccgtcgcctgaaccgcatggcggagcgcgatgtcggcgactggttatatgcacgcttccttaacgataaggcggggacaaatacccgtttcgcggcagaaattattgacgtcagccgcggtggtatgcgcgtgcgactggtcgataacggcgctatcgcctttatccctgccccgttcctgcacgccgttcgcgatgaactggtatgcagccaggaaaacggtacggtacagattaaaggtgagacggtttataaagtgacggatgtcattgatgtcactattgcggaagttcgcatggaaacccgcagcattattgcccgaccggcagcgtaaccacgcttagctcactcaacggcctttgctgagaaggcaaaggccgtttcttttcttcttctcccttccgtcatgctctaagtttaatcttattcaagcgccccatttcttgttatttttagctggcgactatgctttttccagaatctggattacatatgaatacatagataaaacaatacgttcagccataattacccttatttataacatggctaacctttcttttcgggcacctggcgcttaaatgggatggtacgcatgatgaaacagattcaggaacaaacggcgctaaatccccttcactctcactggcgtctggctgatgaccgcaacgtgctgtatctctccccgacaggtgaaacggatgcagaaaaaacggttgagctatcgccggaacaagccgggcgtatccgggaaataacggcgattacgtccagtctgctgataacgttgttgatagaaaaacaggttaccgctgtgcacctggtaggccgtaagattaataaccgtgaatgggctggcagcctggcaacctggcctgatacgcctgccgtctcgccaacgcaggcgcaggagctctcttttgccgagcaaatcgtatcagaagccaactcagtcattgcgatactggatagtcggggaaaaatctgtcgatttaatcggttatgcgaagagtacacaggcttaaaagagcgagatgtaattggtcaaagcgtctttaaattatttatgagccgccgggaggcggttgcctcccgacactacattgagaatttttttcgcaatggcaatgcctatgaaatcgaacgctggataaagacccgtaaaggccaacgcctgttcttatttcgtaataaattcgtccataacggtagcggaaaaaacgaaattttcctgatctgcgcaggcacggatatcaccgaagaaaggcgggctcaggagcgtttacgcatactggcgaatacagacaccgtcaccggcctgcccaatcgcaatgctattcatgaatttattaatcatgctattgcctcggctggcgagtcgcaggtgggtatcgtttatctcgatctggataacttcaagaaaattaatgacgcctatgggcatatgtttggcgatcagctcttacaggccgtttcgctggcgctgttgagttgtctggaggaagatcaattgctggccagactggggggagatgaattcattgtcctcgctgcccatacgtctcaggccgcgctggaagcagtagcctcacgaatccttacccgtctgcggcaaccgtttcgtattggactcattgaagtttacacgggatgcgccattggcatttcgttggccccccggcacggacaggacagcgaaagtctcattcgcactgccgacaccgcaatgtataacgccaaagaaggcggccgcggtcagttctgcgttttttcgccggaaatgaatcagcgcgtatttgactatcactggctggatacaaacctgcgaaaagcgctggaaaacgaccagttacttattcactatcagcccaaaattacctggcgcggcgaagtacgtagcctggaagcgctggtacgctggcaatcgccggaacgcggattaattccgccgctggagttcatctcatacgccgaagagtcaggactcatcgtcccgctgggccgctgggtgattctggatgtagttcgccagattgcgaaatggcgcgataaggggattaacttgcgcgtagccgttaacttttcggcgcgacaactggccgaccagacgctttttactgcgcttaaacaggctttgtacgatctgaattttgagtattgcccgatcgatgtcgagctaacggaaagctgcctgatcgaaaacgacacgctggcgctatcggttatccagcaatttagtcagctcggcgcccagattcatctggatgattttggcacagggtattcttcgctttctcaactcgcccggttccctattgatgccgttaaactggatcaggctttcgtcagagatatccataagcaaccgctgtcgcaatctctggttagggcgattgtcgcggtggctcaggcgctaaatttacaagtgattgccgaaggtgtagaaaatgctaaagaagatgccttcctgacaaaaaacggcgtcaatgaacgacagggctttttattcgccaaacctatgcccgccgtttcttttgaacgctggtacaaacgttatcagacgaaaaaaatgcgttaatggcgacgataatagggagaacagcctgtgcagacaggcatagccctatttttcccttctcttttcagattaatttctgcatcatgaattgaaaccttttctgacattaaggatgacaaacatgtctgatatcgaagcacaacgaattgccgcacgcattgataccgtgctggatatccttgttgctggcgattaccactcggccatcaataaccttgaaatattgagagcagagctgttagatcaggttaaagacggtatctcgccatcccaggctcccgggtcgccctgggaaatctgatagcgattatttgtccgggatggccgttagcccttcccggctctctgactgtctgttgactcctcttaacgaataaaattaatactatgaactcccgacaacaatcaattttgcaaatggtggttgataaaggccagatgagcgttgctgaactggcgaaaattaccggcgtatctgaagtcacgattcgtcaggatctgaataccctggaaaagcagagctatttacgccgtgcgcacggtttcgccgtttcgcttgagagcgatgacgtagagactcgcatgatgacgaactacacgctaaaacgccgactggcggagttcgccgcctcgctggtcagtccaggggaatccgtttttattgaaaatggcagcagcaatgcgctattggcccggacgctggcggaacaaaaagatgtcacgatcatcaccgtgagcagttatatcgcgcacctgctcaaagagaccccttgcgaagtcattctcctcggtggaatctatcagaaaaaaagtgaaagcatggtagggccgttgacgcgacagtttatccatcaagtgcatttcagcaaagcatttatcggtattgatggctggcaggctgataccggttttaccggacgcgacatgatgcgatcggatgtggttaacgctgttctggaaaaaggctcagaagcgattgtcctcaccgacagctccaaatttggctgtgtgcatccctatcccctgggcccgctctctcgcttccatcgtgtcattacggattccaaaatttccgccagcgatcaaatgcagttagaacatgcggggctgctagtcaatgttattggctcatccgtttaaaatatttcccgatggtttgccctatggcaaatcatcctctctctaagacttttctgacatcccaattaagactatttacctgttgtaacgagcgtaacgtcgtaaaattaatattagcgaaataacaggaagtgactatcacctgcgtgatatacccctgcgcaatcaggttttacggaaaatctcttaacaggttttattttaactatagttatagtgagcttaattccgtgaatcgttaattcaggagagagtattatgtttatgacgagcaaaaaaatggccgctgctgtgctggcaatcaccgtagcaatgtctctgagcgcctgctcaaactggtccaagcgcgatcgcaacacggctattggcgcaggtgcgggggcgttaggcggcgcagtgttaacggacggcagtacattaggcaccctgggcggcgcggcggtcggcggcgtgattggtcaccaggttggaaaataatccagacgtttaaatattgaacggctcaaaataatacgtttattcttttcaggtctggattacaaaaatagacaaagttgacttttacgccacggtaatttacaaccgtggcgttttcattagccgccagctaattttactttcattcctttagcttccagcaatgattttatcaagtcgcgtttatcaccctgaatttcaataatcccttcttttactgccccgccacagccgcattttttcttcagttcagccgccagtttggttaattccgcatcattcatctcgataccggtaatcaaacatacgcctttacccttacggccactggtttgacgctgaatgcgaacgataccatcccctttgggacgaaccggcgccgttttaggttcttcaatgcgccccgtctgcgttgaataaaccagacgactattggaatcgctcattatgcctcccgtttcagtgacgcgttaatatccttcagcgtttgcgccggatctaccgattgcgtaaccgggcggccaatcaccatatagtcaacgccagcggataatgcctgttcgggcgtcataatgcgtcgctggtcgcctgcctcgctgcctgcgggccgaatgcccggcgtcactagcttaaatgcagcgccaaaggcctgtttaaatctgacagcttcctgagcggaacagaccacgccatccagcccgcattgctgcgtcaggcgcgccagccgctccgcatgttccgccggtgacaacgtcacgcccagatcgtgtagatcgctggtttccatactggtcaacacggtcacggcaatgagcaacggcgcatctttactgaatggcgccagcgcgtcgcgcgctgcggccatcattctcgccccgccagacgcgtgaacgtttaccatccagacgcccaggtctgccgcagcggcgaccgcccgggccgtggtgttgggaatatcatgaaattttagatcaagaaagacatcaaacccacgttgctggagatcccgaacgagctgtggaccaaacagcgtgaacatctctttgcccacttttaagcgacaatcgcgaggatcgattttatcgacaaacgccagggctttatcgcgttcatggtaatccaacgccacaacgacaggcgattcagtaatagcgcaggaagaagatgaagcagtaaacgtcatgaccagaccttcttgatgatgggcaccggaagtggcgcaaattggataaacggcgtgcattctacctgcggcgcagggaaattaacaggttcgattgacaacctgataagccctggtcgccgatgctagcgtcgtttcttgttttatgtcattaagtatgttgtaactaaagcgaggctttttttatatactactgcccatcaagtccgcgaataggtttaatggtcgaccatgcccggcaggacggacagtgccagtacaaggtataggcggtaaaaccgcatttctgacaacgataccgcggtttactgcgcacctgctcgccaaccatatcacgcagtaccatcaggctttctttcgctcgcccttcttccgcctcgttgagatggtaatccatcagcttatggaacacccgcatggtaggatgtcgctgtagctgacgcgtgatatagacttgagctgcgtcactaccttcacgtgcttccagaatatcggcaagcattaactcagcgccagcaccggtattctcctcaacggcgcgacgtaaaaactccgcccactcggcatttttaccgagctgttgataacaggtttgcagcatctccagcgtttcgctgaccagctctttatcctgaacgatcacacgttgcaggctttcgaccgctttggcgtaatcccctctcgccatataaacgcgccccatcatgatagacacccgggcgctatttttatctgcggcggcaccttttttcagcaacgccatcgcgcgatccatgtcgtcgttgcccatctgctgtaacgctaactcacagtaaaagtgggcgatttcgatacgctgtttatctttgcccagtttcaccagccgttctgctacttcgatcgccttttgccagtcgctggttagctgatagatttgcaagagctgctgtaacgcgcctacgcgaaattccgtttcgtcggtaagttggttaaacatatcttccgcgcggtcatataaaccggcggccatatagtcgcgccccagttgctgaacagccagtaaacgctgttcataggtcaatgaagcgctttccatgagcgtttgatgaatacgaatggcgcgatcgacttcgccgcgtgagcgaaacagattaccgagagtgagatgagcctcaacggtgcccgtatcctctttaagcatatcgaggaacagatccaccgctttatcttgttggttactcagcaggaagttaacccctgcgacataatcgcgcgacaggcggttagcttcatcctgttttgtttgttgcgcacttctgcgacccatataccacccataggcagcggctacaggcaacaacagaaataacaactccaacataaatgattattcctttacaaccgacgaatcggcagggaccgcaacgtcggttgctggcgagagcttgttttccagtcgtttaattttacgttcagcgcgggcaagggaaacgcggacccgcagccagaacaggccgcaaatcagccagccaatcgcaaaaccgacggcgaacagcacagcaagcaacgtggagatacgatactccccttgcgccagcaggtagttaaacgtcacctgttgatcattctgcgcgcccagcgtcaccgaaataacaaaaatcgccaataccagtaagaaaatgagtaaatatttcacattacttcccgttatgtggtttgcgcgaataaatcgtgtccaacttaccgcatccagccttctaaattaccattttcccgcctcgcgcgaaatggaaatgcgcccaccatcagatgatttaagggcaatagtcagaaaatcaaccgttgtcagctttcctgctcgcgttcagcaatttcttgcgcttcttcgcgaggcggcataagcggcccgcaaattcgctgcgccagccaggtcgccagggtaactaatagccaggagatgagcgtggcgaccactaaatctcgcggccagtgcattcccagaagcaaacggctgcccattacgccggtcgcccagactaacaaaaacgcgatggtgaaagtccgtctgcgcggccataacagacccacggccaaaagcgcccagctcgctgcaaacatggtgtgtccggagggaaacgcaaagcccgtctctttttgccagtgctgacgcaggaaaacggggatgttctgttgcccggccaactgctctttcactaaatgtccgcgttctgtacgctttaaagtgtagaactcatcgacgggaatatggtgcgttttttcaagccagaccacaaatggccgcggctcctgtacgcgctcctttacccatgacttcacgccctgcccgacgataatcgccccaccgagaatcgcaaacagcataatggcggcgcgcaggcgaaatcgcaggcaccataagaaccatccacaaagaatcacatgcgtgataacgccccagggtttggtcacggtttccgttatccagaatagcgtttttagccaccagacctgatgtcctggctgccactgccagcctgatacccatacggcaagcggcatgataagcaacagggcggcgcctgccgcggtgcgcctcgcaattgaaagcatggatgctccttttataagtaagtatcacaatcataactgaaaattctcgccggactggaaaattgacaaatttgtgccattcctgagcaattacgtggtagtgattaggtgatgtccgccgccttatggcaaaatagcgggatacaagccaacaggcgacgacaccgcaggcgtcagcataatctggagaaatacatgcagcttaaacgtgtggcagaagccaaactgccaaccccattgggtgactttctgatggtgggatttgaagaactggcaaccggacacgaccatgccgcgctggtttttggcgatatttcaggtaaaacgccggtactggctcgcgttcattccgaatgtcttaccggggacgcgctttttagtctgcgctgtgattgtggttttcaactggaagccgcgctgacgcatattgcggaagaaggacgcggtattctgatttaccaccgtcaggaaggccgcaatatcggcctgcttaataaaattcgcgcttatgcgttacaggatcaaggctatgacacggtggaggccaatcatcagctcggctttgccgccgatgagcgtgatttcaccctttgcgcggatatgttcaaattactcggcgtggatgaagttcgcctgctgaccaataatccgaagaaagtcgaaatactgaccgaggcgggaattaatatcgtggaacgcgttccgctcattgtgggtcgtaatccaaataatgagcattatctcgatactaaagcggccaaaatgggccacctactaagtaagtaagccaccggtattaaagcgcgggcctgcctgtttacggcaggcccgataaacggctttagttcagcatatttctaatgacatagtgcaagatgccgtcattctggtagtaagtcagctcggtggcggtatcaatgcgacagcggcaaggcaccgtttctttgctgccgtccgatctcgttaacgtcaccggaatggtcgcgccagggcgcaggttttgcagatccgcgatatcaatcacctcttccccggtcagtccaagcgttttacgcgttacgccctgtggaaactccagcggcaggatccccatcccaatcaggtttgagcggtggatacgttcgaacgactcggcgatcaccacgcggatacctaacagccgcggaccttttgccgcccagtcacggctcgatcccgacccatactctttcccggcaattaccgccagcggcgttttttcctgctggtagagcatcgcagcatcataaatcgacatcgcttccgtacccggtaaatgccgcgtcatgccaccttcgacgccgggcagcatttcgttgcgaatacgaatattggcgaacgtaccgcgcatcatcacttcatggttgccgcgccgtgatccataggagttaaaatccttccgctcaacgccgtggttttgcagatagcgtccggcgggactgtccggcttgatactgccggccggggaaatatggtcggtcgtcaccgaatcgcccagcatcgccaggatacgcgcgccgtggatatctttgactggcgcaggctgggcctgcatttcatcaaagaaaggcgacaggcgaatataggttgaatccgactgccagccgtaggtatcggacgattcaacctgaatcgatttccattcttccgtgccctcaaacacttccgcatactctttacggaacatatctgatgataccagttcaacggcgcgggcaatttcctgcgccgaaggccagatatccttcaggtataccggatcgcctttacgatcgtaccccagcgggtctgtcgcgaggttaatattcatgtttccggccagcgcatacgcgaccaccagcggcggcgacgccagccagttcgttttcaccagcggatggatacgcccttcaaaatttcggttaccggaaagcacggcccctaccgtcagatcgccttttttaatcgcggtctcaataggctccggcaacggaccggagttcccgatacaggtcgtacagccataaccgaccaggttaaaaccgagctcatccagataaggcgtaagtttggcctgcgccagatagtcagataccacttttgaccccggcgccagagaagccttgacccacggttgacgcttcaaccccagcgttactgcctttttcgccagtaatcccgccgccatcagcacgctggggttcgaggtattcgtacaggaggtgatggcggcaatgacgacagcgccatccggaagctgatatggctgtccgttcatcgtatagtcaaccggctggcgatctctttgcgcggtattcagctccagctcggcgctggcggcaaaggctttcggcacatcgcctaacgccacgcgatcctgcgggcgtttcggcccggccaggctggcctcgacatcgcccatatccagttccagcgtactggtaaataccggttcgtcaccgggattacgccacattccctgcgccttcgcgtaggtttcaaccagctcgaccagatcgtcgctacgtccgcttaatcgcatatattccagggtgatggcgtcaatggggaagaaaccacaggtggcgccatattccggcgacatattagcgatagtcgcgcgatccgccaacggcagcgaatccagaccgtcaccataaaattcaacaaatttacccacgacgccatgcttacgcagcatttgcgtgacggtgagcaccaggtcagtggcggtgatcccctcccgaagcttaccggttaacttaaagccgacgacatccgggataagcatcgacacgggctgaccaagcatcgccgcttccgcttcaataccacccacaccccaccccaatacgcccagaccattaatcatggtcgtatgggagtcagtccccaccagcgagtccgggtaagcaatccactccccgtcctgtaattcgctccagacggctttacccaggtattccaggttaacctgatggcaaatgccggtgccgggcggcaccacgctgaaacggctgaatgcctgctttccccatttcaggaacatataacgctcatggttacgttccatttccagccgcacgttttcttcaaacgcatcatcatcgccgaaatgatcgaccgtcacagagtggtcaataaccagatcaaccggcgataacgggttcactttcgacgtatcgccgccgaggcgtttaacggcttcacgcatcgctgccaggtcgacaacggcaggcacgccggtaaagtcctgcatcaggacacgggcgggccgccaggcaatttcacgatcggcatgggcatttttaagccaaccggccagcgcctgaatatcttcatcagtcacagattcgccgtcctgccagcgcaacaggttttccagtaacactttaagtgatttgggcaaacgggcgatatcgcccagggatttggcagccagcggcagactgtagtaatgatacgttttatctttggcctgcaatgtatccttactggcttctcgtagggttgacgacatagctcctccttaaatgacagggttgcgttaccctgattctccacagggttgtattaaagataacacaaacaaaatgtaacgttttgataacaacccaaattgctaaaagaggagaaacctaacaggcgagaagcgaagatgaaaaagcccgataaataacgcattatcgggctttgacgagattagacggcaatccagattaactcggcccagaacagtagcgataatataaacgcgccagtccatgaccaatactttatatttgacgttaacataggcgacaccaactgtgtttaatcaatactgagaggcgctcagcacacggttgctgcggtgtaataagacagcgttaataaaacagtaacgccaataaaaagacgaatattatttttgtgacacctcgtcagcaaaagcatcaataaatgcccgctgctgcggtgtgggcgtccagtgttgcggaacagaccgaaaaacggtcgtatccggggtgttatcatcgtcaccagattgaatcgggggcgcgaccacgcgctcgcgttccgacgtaatgctcacttagccccaccaatgccagataacaagcgctaccactacccagaacaacgcagaacccacaaaaaccgccagccatgctttacgtttgagctcagggtcgcggcgcggttcctggttttcagaaggcattactaacctcatgctatcggtatcacttatcatttcagcaccaaacaatcggtacaattaatcatcagatgagacaaatcctaaataaactttagtcaaaaatccagtcaatttacgaatcgttgccagtgaataaatcaatcttttgactcaagataactatttggaaaaagaaactggcgggacgggtaattcaacactattttgctgatcattacccgtaatacttcgagggatattgcaaaaggcggctttgtctgccatgccactacgacacaaaccgacggtgatattacttttcaggcagctttatatcctgaaacatcgcttcaatttcttcattagaacgcaacgccaccgccgtatccaccacatcacgcgtcagatgtggcgcaaaacgctggataaaatcatacatatagctgcgtaaaaaagtactacggcgaaaaccaatttttgtggtgctgtggctaaaaatatcgtgcgcgtcaatccgcactaaatcaggatcggcaagcggatcgaccgccatgctggcaatgacgccaacgcccagtcccaacctgacatacgttttaatcacatccgcatcggttgcagtaaagacgatccgcggcgttaatcctgcgcgattaaaagcggtatccagttcggaacgcccggtaaagccgaaggtatacgtcaccagcggatactgcgccagcgcttcgatcgttacggaagacgttgccgccaatggatgatccggcgtcaccactatcgaacggttccagtgatagcatggcaacatcaccagatcgtcatataaatgcagcgcttccgtggcaatcgcgaaatcggcgttccctttcgataccgcttccgcaatctgcgttggcgacccctggtgcatatgcagcgaaacgcgcgggtaacgctcgatgaagcctttaatcacgcctggcaatgcataacgcgcctgagtatgggtagtggcaatatagagcgagcctttatccggccaggtgtgctcgccggcgaccgacttaatggcatcgactttggaaagcacctcacgcgcaatacgaataatctcctgacctgcgggcgtcacctgagtcagatgcttaccactgcgggcgaaaatctggatgccaagctcatcttccagcatccgaacctgcttgctgatccccggctgggaagtatacaacccctcagcggtagaggagacgttaaggttatgattaaccacttcaacaatgtaacgaagctgctgcaatttcataatacatcatccagattagcgccatcaggccatcgtttatctgcagacttaatcgggctgctaatacgatttaataataaaaaaggtgttaactataaccactatatcatttatatctgaactgtatagccagcgcgataaaataataagcccgctatacccaaaataattcgagttgcttaaaggcggcaagggagtgagttcccagaagcatagataacgatgtgactggggtgagcgacaaatctgccgggagcagatttgaacgtcgcgtgcgacggcccgtcagggcgagcccatggatgggccgagtaatccgtagccaacacataagccactttaaatatgaaggggatataaaaaagggccgcttacgcggcccgcttgactatagtgacgacaggcaggggttatttcttgccttcaacccacttgccgtcgacgaagaacgctgaccatcccgtcgccttcccgtctttttccgccgcaacgtactgctgttttgttttgcggctaaagcgaacaacggttttattaccttccgggtcctgctgcggcgcatccgccagataacgcagtttttccggcaggcgatcgcggaaccggtacagctcctcgactaatggcgcgcgagtttcgcgtgatttcgggaacgtattggccgccaggaatatccctgcggcgccatcgcgcagcacaaagtacgcgtccgatttttcacacggcagttccggtaatggaacaggatcttccttcggcggcgcaacttcgccgttacgcaagatcttacgggtatttttacattcgtcgttagtacaggccatgtacttaccaaaacgccccattttcaggtgcatttcggaaccacatttctcacactcaacgatcgggccgtcataccctttgatgcgaaactcgccttcttcaatctcgtagccgtcacaggtcgggttattaccacacacatgcaatttacgcttcggatcgatcagatagctgtccatcgccgtaccgcacttctgacagcgccgcttggcgcgcagggcgttggtttcggcgtcgtcgccttccagcacgttcagaacttcattttccggcaccaggttaatggtcgttttacaacgctctttcggcgaaagcgcataacctgaacaaccaaggaaaacccccgtactggcagtacgaattcccattttacggccacaggttggacagtcgatgctggtcagcaccatctggttaggacgcatccccccttcttccggatctttctcggctttatcgagctgctgagtaaaatcgctgaagaagttatccagtaccgctttccactcggcctggtgattcgcaacctgatccagactatcttccatctgcgcggtaaaatcgtagttcatcaattcgcggaagttttcttccagccggtcggtgacgatttcacccattttttccgcatagaagcgacggttttcaacgcgaacatagccgcgatcctgaatggtcgagataatcgacgcataggtagacggacgaccaataccacgcttctcaagttctttaaccagagaagcctcgctgaaacgggctggcggtttagtaaagtgctgagcaggcgtcaattcaagtagcgtcagcgcatcgcccttattcacggcaggcaatgtgcgatcttcatcgcctttacgcagcgccggcatcacttttgtccagccgtcaaagcgcaaaatacgcccacgcgctttcagacggaattcgcctgcgccaacggtaagcgtagtggagtcatattgtgctggcgtcatctgacaggcgacaaactgacgccaaattagctgatacaacttctgcgcgtcagcctccatgtctttcagagactccgccatgacagcaacgtcggaaggacggatcgcttcgtgcgcttcctgagagttttctttgctggcgtactggttcgggttatccggcaggtatttcttgccgaaattatcgccaatataaccgcgcaccatgttgaccgcatcctgactcaggttggtggagtcggtacgcatataggtgatgtagcccgcctcatacagacgctgcgccatcatcatggttttcttcacgccaaagcccagccgggtgctggccgcctgttgtagcgtggaggtgataaacggcgcgccaggtttgctgctggtcggtttgtcttcacgctccagtacgctatagcgcgctttttccagcaagctgacggcggcaagcgtctgctcgcgatttaccggccggaatggcttgtcgttctgatgcgtcacctgtagcggtagtgcctcgccagacggcgtcgtcgtattagcgtcaatttcccagaactcttccggaacaaacgctttaatctcgcgctcgcgttcaacgaccagacggaccgcgacagactgaacgcgacctgccgacaaaccacgggcgatctttttccacagcagcggcgagaccatatagcctaccacgcgatccataaagcggcgcgcttgctgggcgttgaccctgttaatgttcagctcgcccggctgttcaaacgcctggcgaatggcatttttggttatttcgttaaagactacgcgactgtagcgcgcgtcatcgccgccgatcacttcccgcaggtgccatgcaatggcttccccttcgcggtcaaggtcggttgcgagatagatgtggtcggctttttccgccaactgtttcagttcagagacgaccttctctttaccgggcagcacttcatagtgcgcatcccagttgtgccacgggtcaacccccatacggttgacgagagcgccacgttcatcctttttgggctttttagccgttttggtggaggtagagtcggcgctctttttagctgctgagccactggtcggcaaatcacggatatgacccacgctggatttcaccacgtagtcattacccagatacttgttgatcgttttggcttttgccggggactcaacgatgacaagagctttacccatattcacctttacctaagttgattcttccaggaatgcgtcgcacgttgattcaccttccactggcgacgagacaacgatatatggtctctgcgtctgcggatatcaaccccttgtactggctttgtgtacgaaatgtaaccctcaggtgactgagttaacaggcttttttgcacacacgcgctatagcacgacggaattttggtcgaatgtcaagcaattctgttgccagattgacgaaagcgtcacactgtacctgataaaattcgatacgcaactttattagcatgcaaaaacaaatcttgccagtgaacgcaacatgacaaatccatcaatttcctgtgagaatatttgcccatcagaagtgctcagcgtagactaatctccttgtttaaggagtaaaaaatgcataaagagacgcaacctatcgatcgcgaaacactgttgcttgaagccaacaaaattattcgggaacatgaagacacgatggcaggtattgtcgccaccggcgtaacgcagagaaatggcgtgctggttttcagcggcgattactttttagacgagcaagggttaccgacccctaaaagcaccgcggtgtttaacatgtttaaacacctggcgcatgtgctgtctgagaagtatcacctggttgattaatccatgccggatggcgctgaatgccatccggcaatagcggtttacatcaacggcttttgtccacgctgccaccagcgcagcagcagccgatccgcgctttccgccgcgctgccggtaacacgatcgatcagttttttacgctgcatatagcgcacattcagcacctcgcgcccttccatcaggccgaggataacctcatcgctggtgttaatctcatcaaccagtcccttctccagcgcctgctgaccgtaccagtgttcgcccgtggcgacctgttcaatgtccagagccggacgcatccgctgcacaaactctttgaacagatggtgcgtttcgttgagatcttcacgaaacttctgccgcccttcttccgtattctcgcctaacaaagtcagggtacgtttgtactgccctgcggtatgcagttcaatatcaatgtctttacttttgagaaagcggttaaagttcgggatttgcgcgacaacaccaattgaccccacaatagcaaacggcgccgcgataattttttccgccacgcaggccatcatatagcctccgcttgccgcgactttatccaccgtcacggtcagcggaatatttttatcgcgcaggcgctgcaattgcgatgccgccaggccatagccgtgcacaacgccaccggggctttccagacgcacaaccgcccgatcgccgggtttcgccactgccagcaccgccgtgacctcttcgcgtaacgcattaacttcgtgagcgtccatactgcctttgaaatctatcacccatacgcgcggtttgtccgatgtcgcaatgtcccccagcttcgctttcgctttggcggctttcgcctcctgcttatgcttttttttctgcgctttatgccacagtttttgctgatggccatccatcaacgccgcagcaaggtcatccttcatctcctgatactgctcactcaaattggtcacgcgcagctcgccgcgctgacgtttgcgttgcgtagcattcacgatcagcagcacaatgacggcaatggccaccacaacggtgacgatttttgccaaaaataagccatattcagacaacaattccacgactcccaccttgattaaataacgcgacttgcgctcagtgtacaacaggcatcgaagtcagtctctcttcatccgtatgcctgttgaggaagaaaaagtatgacaagacgttcattttacggcgttatcgcccctgtctgattgaaaaaaaaggcgctttcaggcataaacccgaaaagttaacgcgaagataagacaacctggcaggacggtgcaccacaccgttgaggagtagccatgcattaccaaccgaaacaagatctattgcaaaaccgcattattctggtcactggcgccagcgatggcattgggcgggaagccgcgctcacgtatgcgcgttacggcgcaacggtgattctgctgggacgcaacgaagagaaactgcgtcgggtcgcgcagcacattgctgacgagcaacatgttcaaccacagtggtttacgctcgatctgctgacctgcaccgctgaagagtgccggcaagtggccgaccgcatcgccgcgcactatccccgcctggatggcgtcctgcacaatgccgggttactgggggaaatcggcccaatgagcgaacaagatccgcagatctggcaggatgtcatgcaggtaaacgttaacgccacctttatgctcacccaggcgctgttaccgttattattgaagtccgatgccggctcgctggtctttacgtcatcaagcgttggccgtcagggacgcgccaactggggcgcctatgccacctcgaagtttgctactgaaggaatgatgcaggtgctggcggacgaataccagaaccgttctctgcgtgttaactgcattaacccgggcggcacgcgcaccagtatgcgcgccagcgcctttccgacggaagatccacagaaattaaaaacgcctgccgatattatgccgctttacctgtggcttatgggcgacgacagtcgccgtaaaaccggtatgacctttgacgcccaaccgggccgtaaaccaggaatcgcccaatgagtgatgaacgttatcagcagcgccagcagaaggtaaaagatcgggttgacgcccgtgtcgcccaggcacaggaagagcgcggtattattatcgtgtttactggcaatggtaagggcaaaaccacggcggctttcggaactgccgcccgcgccgtaggacacggtaaaaacgtaggcgtggtgcaatttattaagggcacctggcccaacggcgagcgtaatctgctggaaccgcatggcgtcgaatttcaggtgatggcaacgggatttacctgggagacgcaaaatcgcgaggcagacaccgcagcatgtatggccgtttggcagcatgggaaacggatgctggccgatccgctgcttgatatggtagtactggatgagctgacctatatggtggcgtatgactatttaccgctggaagaggtcataagcgcgctaaacgcgcgccctggtcaccagacggtgattattacaggtcgcggctgtcaccgggatattcttgatcttgcggataccgtcagcgaactgcgtccggttaaacatgcttttgacgcgggcgtaaaagcccagatgggaattgattattaaccgtaggccggattaaggcgtttgcgccgccatccggcacaaaccctcttgtctgatgatcctcggcctatagaccgcggtagagattacccgttgttattacgcccaccggagcggcgtccgccagctatctggctgtggcgttttaccgcccgacggatctggttcgctttcatacgacgacggtctttttcgacggcaaccttcgacgaggtttccggcgggagctctaccagaccacgcagatagttcgtttgcgcgaggtcgagctcagtccagccgccgcgcggcaggcctttcggcagcgggatatcgccgtaacgaacgcggatcagacggctgacctgaacgcctaccgcttcccacagtcggcgaacttcgcggttgcgcccttccgtcagcgtcacgttataccactggttaatgccttcgccgccgctgaatttaatggtcttaaatgccgccgggccatcttccaactgtacgccacggcttaaatcacgcagtttcgattcatccacctgaccgaacacgcgcacggcatattcacgttcaacttcgcgactaggatgcatcaggcggttcgccagttcaccgtcggtggtaaacaacaatagcccgcaggtgttgacatccagacgtcctaccgcaatccaccgcgcgccgcgcagtttcggtaagcgatcaaaaacggttggccgcccttcagggtcattgcgggtacacagttcaccttctggtttgtaataggccagaacgcggcaaatttgttccgccgactctttcaccgaaatcaggtgaccgtcgatacggattttcaaaccgggagtgacttcaacacgatcgccaagcgtggcgattttaccgtcaacgctgacacgtcccgcttcaataatggattcgatttcacggcgagagccgtggccagcgcgcgccagcactttttgtaacttttcgctcatagagcttccttcaggtgtcgccttcacaggcgtcgaacaggagaatgaacggcgcgttgccgcgccattttaaggccgcgtagtatacaggcttacgcccttataagaaaggtgtaacgtcgccgacgccttcgcgcagcaccaccggggagtcattggtcaaatcgattaccgtggtaggctgttgaccgaggtaaccaccgtggatgatcagatccacctgcttctccagccgatctttaatctcctccgggtccgactcggtaaaatcgctgccaggcagcatcaacgacgtcgagagcatcggttcgcccagcgtatccaataacgccaacgcaatcgggtttgacggtacgcgcaggccgatagttttacgcttttcctgcaacagacggcgcggcacctcttttgtccccttcaggataaaggtgtaattacccggcgtattgtttttcatcagacgaaatgccacgttgtcgacgtaggagtaggtcgacaactcggacaaatcgcggcacatcagcgtgaagttgtggccgtccggcagatgacggatgcggcaaatgcgctccattgcgcctttgtcttcaattttacaaccaagggcatagccggaatcggttggataaacaataacaccgcctttacgcacaatgtcgacggcctgattaatcagccgttgctgtgggttatccggatggatataaaaaaactggctcatacttccctcactgtgatatttgcggctgttcccatgtctgccatacgccttcaacgccagcgggcagccagagtttacgccccaactcaatccacgggcagggctgatggaaatcagatccaagcgatgcccataaatgatgctgacgcgcaagcgtcgccagttgggtgcgttcattgggcgattgttggcactgcgccacttccatcgcgtcgccgtgatggtcggcaaaatgcgccactaatcttttcagccacttagcgctaaggtcgtagcgtcccggatgggccaacaccgccttaccgccagaatgatgaatgacatcaatagcttgttctattgtacaccactgcggcggaacgtaaccggttttcccacgcgcgagatattttttaaaaacatccgccatggtcgcggctttgccgcactccaccagaaagcgggcgaagtggccgcgcgtcaccgcgccgccattggccagtctcaatgccccttcccacgcgccgggaatatgggctttttccagacgctccgcaatgagccgaccgcgtgcctgacgccgctctgtctgctgcgccagaaaatcgcgcattgccggatgcgcaatatcaatattcagacccacaatgtgaatctcatgattctcccagaccgttgaaatctccacgccgggaataagattcagggccagtccggaacgtgaaatttcttctcttgccgcaggaatcgcggctgtggtgtcatgatcggtaatcgccagcgtgccgactcgcatctctaccgcacggtgtactaatgtttctggcgtcaacagtccatcggacgccgtggtatgactgtgcagatcgtaaatcactgcgtaattcgtgtcgctcaaggcggctcccatagagataaagttatgtcatgtacatcataacggttccggcaaatatactgaaataggtgttgacattattccatcgaactagttaactagtacgaaagttcacatgaagagggtatctaaaatggcagcgacatttgcattacacggttggtggcgcacttcctgatagcgggcggtgtatgaacagctgtaatcagccaaacgatacccggcccgcctgttaagcgggcttttttttgaacaaaataatgagaataaccatgcaaacaccaaaacccacgctcgaactgttgacctgcgatgccgcctatcgggaaaacccaacggcgctttttcaccaggtctgcggcgatcgcccggcaacgctgctgctggaatccgcggatatcgacagtaaagatgatttaaaaagcctgctgctggtagatagcgcgctgcgcattaccgctttaggtgacactgtcaccattcaggcgttatctgataatggcgcctcgttattgccgctactggataccgccctgcccgctggcgtggagaacgatgtcctgcctgccggtcgcgttctacgcttcccgcccgtcagcccattattagatgaagacgcccgtttatgctctctgtcggtatttgatgcgttccgtctgttacagggagtggtgaacataccgacgcaagagcgggaggctatgtttttcggcggtctgtttgcctacgacctggtcgctggctttgaagcgctgccacaccttgaggctggcaataactgcccggactactgcttttatttagcggaaacgctgatggttatagatcatcagaaaaaaagcacccgtattcaggccagtctgttcaccgccagcgaccgggaaaaacagcgcctcaacgcccgcctggcgtaccttagccaacagttaacccagcctgcgccgccgttgccggtgacgccggtgccggacatgcgctgtgaatgcaatcagagcgatgacgcgttcggcgcggtggtacgccagttgcaaaaagccatccgcgcgggcgagatatttcaggtggtgccgtcgcgccgcttttcactgccctgcccgtcgccgttggctgcctactacgtgctgaaaaagagcaaccccagcccgtatatgttctttatgcaggataatgatttcacgcttttcggcgcgtcgccggaaagctcgctgaaatatgacgcagccagccgtcagattgagatttatcccatcgcgggtacccgtccacgcggtcgccgcgccgatggtacgctggacagagatctcgacagccgtattgagctggacatgcgtaccgaccataaagagctttccgaacatctgatgctggtcgatctggcgcgcaatgacctggcgcgcatctgtacgccgggcagtcgctacgttgccgatctgacaaaagttgaccgctattcatacgtgatgcatctggtttcccgggtggtgggcgaactgcgtcacgatctcgacgcgctgcacgcctatcgcgcctgcatgaacatgggcaccctgagcggcgcgccgaaagtacgcgccatgcagttgattgccgatgcggaaggacagcgccgcggcagctatggcggcgcggtcggttacttcaccgcccacggcgatctggacacctgtattgttatccgttccgcgctggtggagaacggtatcgccaccgtacaggcgggtgccggaattgtgctggactctgttccgcagtctgaagccgatgaaacccgtaataaagcgcgcgccgtattgcgtgctatcgccaccgcgcatcatgcacaggagaccttctgatggctgatattctgctgctcgataacatcgactcgtttacctggaacctggcagatcagctacggaccaacggtcataacgtggtgatttaccgtaaccatattccggcgcagacgcttatcgatcgcctggcgacaatgaaaaatccggtgctaatgctctcccccggtccgggcgttcccagcgaggcaggctgtatgccggagctgctgacccgactacgcggcaagttaccgatcatcggcatttgtctggggcatcaggcgattgtcgaagcttacggcggttatgtcggtcaggcgggagaaatcctgcatggcaaagcctccagcattgagcatgacggtcaggcgatgttcgccgggctggcgaatccgctaccggtcgcgcgttatcattcgctggtcggcagtaatgttcctgccgggctgaccattaacgcccatttcaacggcatggtgatggcggtacgtcatgatgcggatcgcgtttgcggttttcaatttcatcctgagtccatcctgacgacacagggcgcgcgtctactggagcaaacattagcctgggcgcagcaaaagctggaaccgaccaacaccctacagccgattctggagaaactctatcaggcgcaaacactgacgcaacaagagagccatcagttgttttcggcggtcgtccgcggcgaacttaagcctgaacagctcgccgccgcgctggtgagcatgaaaattcgcggcgagcatcccaatgaaattgccggcgccgccactgcgttactggaaaatgccgccccgttcccgcgcccggagtatctgtttgcggatatcgttggtaccggcggcgatggcagtaacagtatcaatatctctaccgccagcgcctttgtcgcggcggcctgtggactgaaagtggcgaaacacggcaaccgtagcgtgtccagcaaatcggggtcatccgatctgctggcggcgttcggtattaatctggatatgaacgccgataaatcacgtcaggcgttagatgaactgggcgtctgtttcctgtttgcgccgaaatatcacaccggactccgtcacgcgatgccggttcgccaacagttaaaaacgcgaaccctgttcaacgtactcggcccgctgatcaacccggcgcatccgccgctggcgttgattggcgtctatagcccggaactggtgctgccgattgcggaaaccttacgggtactgggctatcagcgcgcggcggtggtacatagcggcggcatggatgaggtttcgctccatgcgccgacgattgtcgcggagctgcatgatggcgaaattaaaagctatcaacttacggcggaggattttggcctgacgccttaccatcaggatcagttggctggcggcacgccggaagaaaaccgtgacattctgacgcggttattacaaggtaaaggcgatgccgcgcatgaggccgccgtcgccgccaacgtggcgatgctgatgcgtctgcatggtcaggaagatctcaaggccaacgcgcaaaccgtgcttgatgttctgcgcaacggcaccgcatatgacagagtcaccgcactggcggcaagagggtaaataatgcaaaccgttttagcgaaaatcgtcgcagacaaggcgatttgggtagaagcccgcaaacagcaacagccgctggccagttttcaaaatgagatccagccaagtacacgccatttttatgatgcgctccagggcgcgcgtaccgcctttattctggagtgtaagaaagcatcgccatcaaaaggcgtgattcgcgacgatttcgatccggcgcgtattgccagtatttatcaacattacgcctcggcgatctcggtgctcaccgacgaaaaatattttcaggggagcttcgattttctgccggtcgttagccaaagcgcgccgcagccgattctgtgtaaggattttattatcgatccctatcagatctaccttgcccgttactatcaggccgatgcctgtttactgatgctctcggttctggatgacgaacagtatcgccaactctccgccgtcgcgcacagtctgaaaatgggcgtgctcacggaggtcagtaatgacgaagaacgggagcgcgcgatagcgttaggcgcaaaagtggtaggtatcaacaatcgcgatctgcgcgatctgtcgattgatttgaatcgcacccgccagctggcgccaaaactgggccacggcgtgactgtcatcagcgagtccgggattaacacctatggtcaggtacgcgaactgagccacttcgccaacggttttttaattggctccgcgttaatggcgcatgacgatcttaacgccgccgtccgtcgcgtgctgcttggcgaaaataaagtctgcggcctgacccgcgcccaggacgctaaagcggcctgtgacgctggcgcaatatatggcgggttgatttttgtgccctcatctccgcgcgcggttagcgttgagcaggcgcgagaagtgataagcggcgcgccattgcagtatgtcggcgttttcaagaacgctgatatcgccgatgtttgccagaaagccgccgtcctgtcgctttctgccgtacagctacatggcagcgaagaccaggcgtatgtcaacgcgctgcgcgaggcgttgccgaaacaggtgcaaatctggaaggcgctgagcgttagcgatgcccttcccgcacgcgattatcaccatgtcgataaatacattttcgacaatgggcaaggcggcagcgggcagcgcttcgactggtcactgctacaggggcaaccgctggataatgtgttactggcgggcgggctggcggccgataactgcgtccaggcggcgcaagtcggctgtgccggtctcgattttaattcaggtgtggagtcacagccgggcatcaaagatgctcgtcttctggcctcagtttttcagacactgcgcgcatattaaggaaaaaacatgacaacacttctcaacccctactttggtgaattcggcggcatgtatgtgccgcagatcctgatgcctgcgctgaaccagcttgaagaggccttcgtcagcgcgcaaaaagatcctgaatttcaggcgcaattcgccgatctgctaaaaaactacgcgggacgccccaccgcgctgacgaaatgccagaacattaccgccggtacgcgtaccacgttgtatttaaagcgcgaagatttactgcacggcggcgcgcacaaaaccaatcaggtactgggtcaggcgctgctggccaaacggatgggtaaaagcgagattatcgctgaaaccggcgccggtcagcacggcgtcgcctctgcgctcgccagcgccctgctgggtctgaaatgccgtatctatatgggcgccaaagacgttgagcgccagtcgccgaacgtcttccgtatgcgtctgatgggcgctgaggtcatcccggttcatagcggctccgctacgctaaaagatgcctgtaacgaggcgctgcgcgactggtccggtagttacgaaaccgcgcactatatgctcggcacggcggcaggaccgcatccctatcccaccatcgttcgcgagttccagcgcatgattggcgaagagacgaaagcgcaaatcctcgacaaagagggccgtctgccagatgccgttatcgcttgcgtcggtggcggctcaaacgctatcgggatgtttgccgattttattaatgataccagcgtcgggctaataggcgttgaacctggtggtcatggtattgaaaccggcgagcatggcgcgccgcttaaacatggtcgcgttggcatctatttcgggatgaaagcgccgatgatgcaaacagcagacgggcaaattgaagagtcctattccatttccgccgggctcgatttcccgtccgttgggccgcaacatgcgtacctgaacagcatcggacgcgcggattatgtctccattaccgatgatgaggcgctggaagccttcaaaacgttgtgccgccatgagggaattatcccggcgctggagtcctcccacgcgttggcgcacgctctgaaaatgatgcgcgagcagccggaaaaagagcaactgctggtggtcaatctctctggccgcggagataaagacatctttaccgtacacgatatcctgaaagcgcgaggggaaatctgatggaacgctacgaaaatttatttgcccaactcaacgatcgccgggaaggcgcttttgtccccttcgtgaccctgggcgaccctggcattgaacagtcactgaaaattattgacacactgattgacgctggcgccgacgctctggaactgggggttcccttctccgatccgctggccgatggccctaccatccagaatgcgaacttacgcgccttcgccgctggcgtcacgccggctcagtgttttgaaatgctggcgctgattcgtgaaaaacacccgaccattccgattggcctgctaatgtacgcgaatctggtgttcaataacggcatagatgcgttctatgcccgttgtgaacaggttggcgtagattccgtgctggtcgcagatgtcccggttgaagaatcggcccccttccgccaggcagcgttacggcataatatcgcgccgatcttcatctgcccgccaaatgcggatgacgatcttctgcgccaggtcgcatcttacggccgcggttacacctacctgctttcgcgttcgggtgtcaccggcgcggaaaaccgtggcgcattgccgttgcatcatctcattgagaagcttaaagagtaccatgccgcgcctgcgttacagggcttcggtatctcctcgccggaacaggtgtctgcggccgtgcgtgccggggcggctggcgctatctccggctcagccattgtcaagattatcgagaaaaacctcgcgtctcccaaacagatgttggcggagctcaggtcctttgtctcagccatgaaagccgccagccgcgcataacgggttaagccgtcagcataacgctggcggcttaatgagtggctggcgccgaaccagaatcacgattcagacgtacatcatcaatctttttggtgttattccccgtccagctttcaaaaagtctgaagtcaatttttgctaagaaaactcctaatcacgccgaaaaatttagcgttttcacgtcaatttcccccgcctttatgtaaagaaatgtcaacaaacaatgcattaacgtttccagggccgcagatagtgacgattgttattaataacaatgcaaagcatttcctgttaaatcgcttattctaaaagaaaatatagaatatattatctctaaaccattttttgtgcgttatttacgcggtaaatcacaactatttccgtcaatttgactaatcggtttaaccaactaattttaatagggtgtcgacacggttaaaaccgattttttcagcaagcaacgagacaggagaaataatatggccgaacatcgtggtggttcaggaaatttcgccgagaatcgtgaaaaagcatctgaagcgggccgcaaaggcggtcagcatagcggcgggaatttcaaaaacgatccgcaacgagcttctgaagccggtaaaaaaggtggtcagaatagtcacggcggacgtaaatccgataattcctgatttactgtaatgtaaatataacacatgcttttatcaagcaatctgcgagtcttctggctcgcagtattttgcccaggagaattagatttatgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataatatttttaattatcagcttgcatgattccgattttattatcggagcagattatcacgcattgaggaatgtaaaatgaattatactgaacattatcatgactggcttcgtgacgcccatgccatggaaaaacaggcagaatcgatgcttgaatctatggccagccgtattgaaaattatcctgatataaaagccagaattgaacaacatattagtgaaaccaaacatcaaattaccatgctcgaagaagtgttggaccgtaatggcatttcccgttcggtgttgaaagactccatgagtaaaatggcagcaatggggcaatctatcggtggcatgttcccttccgatgaaattgtcaaaggttcaattagcggttatgttttcgagcagttcgaaattgcttgttatacctccctgctggcggcggcaaaaaaagctggcgacactgcctcaattccgacgattgaagccattctgaaagaagaaatgcaaatggctgactggcttatcaaacatattccgcagacaacggaacaatttttactgcgatctgaagcagatggcgttgaagccaaaaaataaataataagcaggaggcaatatgtttcgacacgtaaaacaacttcaatatactgtgcgagtgagcgaacctaatcctggattagcgaacctgctgctggaacagtttggcggcccgcagggcgaactggcggccgcctgccgctacttcacgcaaggtttaagcgatgatgatgccggtcgtagagaaatgttaatggacatcgccaccgaggagctgagtcatctggaaattatcggctcactggtaggaatgcttaataaaggcgctaaaggcgagctggcggaaggtaccgaaaacgaagcggaactttatcgctcgctgacgcagaatggtaatgatagccatatcacctctctgctgtatggcggcggcccggcgttgacaaactccggcggcgtaccgtggaccgcggcttatattgatactatcggcgaagtcacagccgatctacgctcaaacatcgcggcagaggcgcgagcgaagatcatttatgaacgcctgattaatctgaccgacgatcctggcgtaaaagacacactcagtttcttaatgacccgtgaagtcgcgcaccagctctcttttgaaaaggcgctgtattcgattcgtaacaacttcccgccgggtaaattaccgccggtagaacagtataccgacgtgtactacaacatgtcgcaaggcgacgatccgcgaggtagctggaatagcgatgagaacttcaactatgtcgcagaaccgatgcctgctgttgatggcggcgatggcctggcgacagtgaaattgccgcgcgagcagatggcgctgctcaaagcgatggcagaaagaacgaaatcggaccccaccgttgatcctctcactggcgcagaactaggctgcggcgaaccgaaagaagacaagtgagttccgacaagtaaaatccgtgtgtcatgtccttttttgaccccgcctggcggggtcttttttcgtcacaacatcacgcgattagaaacgatagcctgccgagaacataaatacccatgggtccagacgcacgctgtcatgatgctgaacgccgcccattttataattggcggtagtatcaatatccatgtaccagacagaggcgccaattaaccagtcgcggttaatcaggtaatctaccccaacttgccctgccgcgccccaggaatccttaaagctcagatcggacagcccggcatttttaccattatcgttaaagtcgttatcgaagaaggtggtgtagttcacccccacgccgacataaggacgcactttgctgctggaatcgccgaagtaccactgcgccattaacgttggcggtaacaggtggaccgtggcgatatcgcccgtcgcgcccgtacccaccttatggcggaacggcgtagccgccagcaattcaaccccgatattgtccgtcgccatgtaagtgaatgtcaggccgagttgcgtgttattactcacatcaaacccgtttaaatgccccagcgtaccacccgccccttctgtaggtctgacggttgccggacctgcacgcataaagaattctccggcttcgtgcgcgaacgcgctgcctgagagaagagttgttaacgccagtgccgccactgtaaattttttcatacccgctccatcgttatggttataaaagcgtgatgaatatacccacaatgaagtaataagtgatctaatacagatcacatttgttcttataatttaacatttattgatccagattaatttagaacttgtattgaaaatcctggttataggaattcagatcaattttgacatattcacgctatgcaaatatttgtctgctcctgttgccctggcgataaaggctggctaaggtaatcaatgtcccgcaatggcgcgtggcgttaagattcgcgaacactgcgggacagattaatttccgttgtaatctattgatacgttagttttttgcaggtgaatcatgagcgttcttaacccatgcatgacatgcggtgcctgttgtgcctattttcgtgtctccttttattgggctgaaggcgacgatgccagcggacgcgttccggcgtcattaaccgagcctgttaccccttttttacgttgtatggccggtaccaaccaaaaacagccgcactgtaaagcgctaattggcacgccgggtgaaaacgtcagttgcgctatttatgaaaaccgcccttcaacctgtcgcgaattttcgatatcgggcgaaggaggcgaagtgaatgaggcgtgtaatcgcgcccgcgcgcgatacggattaccgccgctttacaaagatatgcttttccatacaactgctgatgctgccactgtagagttatccagggtacaattgcccgcaaattaacacctgcaaaactcaaggagagtgcatgtctatcacggcgaagtccgtttaccgtgacgccggaaattttttccgaaatcaatttattactatcttgctggtttcgttgctgtgcgcatttatcacggtggtcttaggtcatgccttttcacccagcgatgcgcaaatcgcgcaactcagtgaaggagaacatctggcaggcagcgctggcctgtttgagctggtacaaaatatgacgccggagcagcaacagatcctgttgcgcgcctctgccgcctcgacgttttccgggcttatcggcaacgctattctggccggcggtatcatcctgatgattcagttagtttcagcgggacatcgggttagcgcgctgcgcgctatcggcgccagcgcccctgcattgcctaaactgtttattcttatttttctgactaccctgttagtgcaaatcggtataatgctgattgtcgttccggggattattatggccattgtgctggcgcttgcgccagtgatgttggttgaagagaaaatgggcgtgtttgccgcaatgcgcagcagtatgcgtttagcctgggctaacatgagactggtcgcgcccgcggtgataggctggttactggctaaaacattgctattgctgttcgcgcccagcttcgctgtactgaccccaaatgtaggcgctgtactggcgaatacgttgagcaatctgatttccgcagtattgcttatctacttattccgcctgtatatgttgattcgccaataatccgcaatgcgccgttacgcggcgcattcgacgctcgttgatgatggaatcgaagaatgaagcagtttctggattttttaccgctggttgtcttttttgcgttttataaactttatgacatctatgcggcgacctccgcactgattgtcgcgacggcaatcgtgctgatttatagctgggtgcgctatcggaaaatagagaagatggcgctgattacctttgttctggttgccgtcttcggcggtctgacgctcttcttccataacgatgaatttattaaatggaaggtgacggttatttatgcgctgttcgccggcgcgctgttaataagccagtgggtgatgaaaaaaccgttaattcaacgtatgttaggtaaagaactggcgttgccgcagcaggtctggtcaaagctgaacctggcgtgggcgctgttttttattgcgtgcggtctggctaacatttatatcgccttctggttgccgcaaaatatctgggtcaactttaaggtctttggactcacggcgctgacgctcatttttaccctgctgagcggcgtctatatctaccggcatctgccacaggaagataaatcataaccctcccgtgacttatcatcgccagactgcgaacgcctggcgatattttctccgcctttacgccctgcgctttcccgtcagtacctttattcccactattctccacacaaaattcatagtagcatcgcggctgtaattttttctgatagtcggttttacaatgacaacaatggataatactcctcagggcgagctggttttacgtacattggccatgcctgccgataccaatgcgaacggcgatatttttggcggctggctgatgtcgcaaatggatattggcggcgcgatactggccaaagagatcgcgcacggtcgggttgtaaccgtacgcgtggaaggaatgacatttctgcgccccgtcgcggttggcgatgtcgtatgctgctacgcgcgctgcgttaaacgcggtacgacgtctattagcataaatattgaagtctgggtgaaaaaagtcgcgtcagaaccgattgggcagcgctacaaggccaccgaggcgctgtttatttatgttgccgtcgatccggacggtaaacctcgcccgctcccggttcagggttaagtatacccgcttacgccgccagcaggtgatggtatattcctggctggcggcgccagagattactcaatctgcgccgtaccgttcagacggaagataatattgaccaccagcccggaacccggcttgcctgcttcatagcgccattttcgcatcgcattcttaacttcacgctcaaacatattggctggctgcgcggatagaatctgtacattttccactcgcccagcagaggtcacgtcaaacttcacctttacgcggccttcaatacgtaacgcctgtgctcgcgccggatactgcggctggttacggctcagagcgcgaggtccagtgggcacgctcaccgcgggcttgctggtcgccgatgcggtgctgcttgttggccgcaccggggcgctattttcaaacggtgaggcaggacgcggcgcggctggtttgacttcgcgcttcggctgctcttcaacctttttcaccggtttcggttttggcttgggttttggcttaggtttgggtttctcaatcaccacgggcgcttctttaggcggttcagggatcggctctggctccggttcgggttcgggttcaaccaccggctccggcggcggctgaaccgcctggggcggctccaggtcagcgggtgaaaccattgtcaccgtgataggctgcgctggcgcaggcaattcaataacctgatgtaccgaggtatagagcaaacctgccactacagcaccatgaatgcctacggaaaggagtgtcggccagggaaagcgacgaggtaaatcaagggtcattgaagtcataatcgtttcagttgaaaaaccagagctgaattttaaatgcaaatagcaatcatattcaataaggcattgccgatagcggcatttaaaagatgatatcgcacaaaaacaccacacaaaatgtgcatgtttaacaaagtcggtatctttacattgcagttaaatgccctttccaataacgtaatcagcaacttttaccgattaaggagctctacccgtgctgtatgttatttacgctcaggacaatgccaactcgcttgaaaaacgcctctcggtacggcccgcgcatctggcgcgcctgcaacttctgcatgatgaagggcgattattaactgccgggccgatgcccgcagtggacagtaacgatcctggggtagccggatttaccgggtcaacggtgattgctgaatttgaatctttagaagcagcgcaatcctgggctgatgcggacccctacgtcgccgcgggcgtctatgcgcaggtttcggtcaaaccgtataagaagatcttttgaaaaggatggcctgttgggcaccgcatacggtgccctttctggctcacacaccgtgaatcgcaaagagtaatgaattacgctgacgattaaagatgcatttcctgatggtatggatacgcatattacggcgtgattgcccttcaagccaacgcgctttacggcggctcgcctgacgtagcattcgccagcgccccacttccgttctactacgcttcatgtttacgactctcactgtaacagaagcgccattataccccctcgccggatgcagaccagcgcttttcccgtgtttttatttgccatgtgaatcctgacgcgtaaactcttaacaacacgctttttaaaggatttttaaagttatgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtcaaaggcaaccagttgcaattgcttaccgactccgatgatgtcatgcaggcgcttattcgcgatatccaactggcgcggcataatatcgaaatggtgttttacatctggcagccaggcggcatggcggatcaggtcgctgaatcgctaatggccgccgcccgccgcggcatccattgccggcttatgctggactccgcgggtagcgtcgctttcttccgcagcccctgggcggccatgatgcgtaacgctggcattgaagtcgtagaggcgctgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttggacaatgggtcgatttgatggcgcggatggaggggcccgtggcgacagcaatggggattgtttactcctgcgattgggaaatcgagacgggtaaacgcattctgcctcccccgccggatgtgaatattatgccgtttgagcaggccagcgggcataccattcataccattgcttccggtcctggatttccggaagatctcattcaccaggcactattaaccgccacctatgctgcgcgcgaatatttaattatgaccacgccatatttcgtccccagcgacgatctgctgcacgctatttgtaccgctgcgcagcgcggcgtggatgtcagtattatcctgccccgtaaaaatgattcactgctcgtcggctgggccagtcgcgccttttttagcgagttactggcggcgggcgtgaaaatctatcagttcgaaggcgggctgttacataccaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcacgtttgtgggtaaaacgtccgttatggcagcgtattaccgagcgattgttttacttctttagtccattgctgtaaaacgtgaccaacatgagtaaacaggtagtcactatggaaatggatctgaacaatcgcctgactgaagacgaaacgcttgagcaggcttacgatatttttcttgagctggcggcggataatcttgatccggctgatatcattctgttcaatttgcaattcgaggagcgcggcggcgcggagttgtttgatcccgctgaagactggcaagagcacatcgattttgacctgaatccagacttttttgccgaggtggtaattggcctggcggataccgaagacggcgaaattaacgacatttttgcccgcgttctgctgtgccgggaaaaggaccacaagctgtgccatattctctggcgcgaataagcggttcaggccggatggcgtctgattgcgccctccggcaagcctgtttaatccggtagcttactgccgcatcggttacaatattgcgcgctatgttcatgctggctttgctggcactgcggacattttcgctgccagtgacgtttttgaaacgcgctgctcatgtgcgtggtaatcagtcctgtaggaatcgcaatcaccgaatagccaatcaaaataagcaccgacgcgacaatacgtcccagcggcgtatgcggcgtaatatcaccgtaccccacggttgtgactgtcactatcgcccaatacaccgaggcattaagcgtcgtgaagccatatttcggtccttcaataagatacatcagggcaccgaaaataatcatcacgatcgcaataaatgaatagaacagaataagctgatgacgcgcgctaataatggcgctccagaatacccgcagcgatggcataaagcgtagcagtttaagaatacgcagcacgcgaatcgctcgcatagcgcgccaggcaaacatatagttcaggctaatttccggccacagccacatgacgtacagcggcaaaatcgtcaccagatcaataaatccccagaaactaaaaacgtattttgccggttcgggccagctaaacagtctgagcaagtattcaccggtaaatatcagggtaacgcagagctccagccagacaaaaatatgccattcatcaaatgtcaggtgatattccgttcctacgcctgattcaacaaaaatgaccagtacgctaagcagcgcaaacagcgcgcataacccttcaaaacggcgacctgagcgcgtagtcaaatcgaacagattatgataaagacgacggcgaaccgacgacaaagaaagtgacacggtaacctcacctaaaagaagggctgacgaattgtcagcccttgcgattataacgggtctactttaaggcaggaaacggcatggcgaaaactcccttccagcaccggtcgcgtttgcgcgcattctggcccggctatcggacagcgtgtacggaacacgcagccggaaggcgggttaatgggcgaaggtaattcgccctccagcaattgtatcttcttatttcgctccagatcgggatcgggaatcggtaccgccgacatcagcgctttggtataaggatgcagtggattatggtacacctcatcataggtgcccaattctactgcatgaccgagatacatcaccaggacacgatcggatatgtgctttacgaccgccagatcgtgcgcaataaaaatcaacgacagccccatctctcgctgtaactgctggagcaaattcaccacctgcgcctgaatagaaacgtccagcgccgacaccggctcatcgcaaataatgagcttaggttccaggatcaatgcccgggcgataccgatgcgctggcactgccccccggaaaattcatggggataacggttgatgaggttcggcaacagccccactttcagcatcatggctttcacgcggtcacgcacgtcctggcgcgaaagtttaggatgataagtgcgcagcggttcagcgataatttcgccaatcgtcattcgcgggttgagtgacgccagcgggtcctggaaaatcatctggatatcgctgcgcacctcgcgccactcatccgctttcatgcccagcagatcttttcccagccaggcgactttaccatctgtcgccttcaccagaccaataatcgcgcgcgcaaacgtcgacttgccgcagccggattcgcccaccacgcccagcgtttcgccttcatacaggcgtagcgtaacgccgtccaccgctttcagggttttcggcggttgccagaaccactgcttcccttctttgatatcaaaatgtactttcagatcggcgatttcgaggagaactttacgttgttcaatcacagcattcatagcagttcctccaccggtttaaaacaggcgcgcaagcgaccaggactaaacgcttcaagtggcggcgcattattgcagatctccatcgcatgaggacaacgcggctggaacggacaacctttaggcaaacgcaataaattgggaggattgcccggaatcgtcagcatttccgccccctcgctatccagacgcggcaccgcattaagcaggcctatcgaatacggatgaacgggctgataaaagacatcgcgcgccttaccgtattccatggtacgcccggcatacattaccaggaccttatcgcaaatacccgcgaccacgcccagatcgtgggtaatcatgataatggcggtattaaattcgcgctttagctcattaagcaaggtcataatctgcgcctgcacggtaacatcaagcgcggtggtaggctcatcggcaataagcagtttcggcctgcacaacagcgccatcgcaatcatcacacgttgacgcattccgccggaaaattcgtgcgggtacattttcatccgtttgcgcgcttccggcatttttacggcatccagcattctgacggactcttcaaaagcttccgctttgctcatccctttatgcagcatcaggacttccattaactgctccccaacgcgcatataaggatttagcgaggtcatcgggtcctgaaaaatcatcgaaatctgttctgcgcgcagcgtattcagttcgcgctcaggtagattaagaatttcacgtccgttgaaggtcgcggaaccgccgattcgaccattcgtcgccagcagtcccattaatgcgaacgccgtttgcgatttccccgatccagactcgccaacaatacctaacgtttctccagcgcgaagcgtaaagttcagatcgttgaccgccgtcacatcgccatcaggcgtagcgaacgtaacacgaagatcgtttacctccagcagtacattcgccggttgcggcgcctgagttgcggtttctgataagctcatggctgtactccttaacgatctttcgggtcgagggcatcacgcaggccatcgccaataaagttaaaacagaataacgtcaccacgagaaagccagccggaaacagcagcagccacggtgagacttccattgaatttgcgccatcgctcaataacgctccccaactgcttaacggttcctgcgtcccaagccccaggaaactgaggaaagactcaaacagaatcatgctgggcaccagcaacgatgcatacactaccactacgcccaggacgttaggcacaatatggcggatcacaatgctggcagtcgacacaccacccacctgcgcggcttcgatgaattctttacgtttaagacttagggtttggccacgcacgatacgcgccatatcaagccaggagaccatgccgatggcgacgaaaatcaacagaatgttctgcccaaaaaacgtcaccagcaaaatcacaaagaacataaacgggaacgagttgaggatctccaacaaacgcatcatcacagaatcaattttgccgcccagatagccggacagcgagccatacagcgttccgacaatgaccgccaccagcgcggcggcaatcccgaccattaatgagatacgcccgccgatggcaacgcgcaccaacagatcgcgcccggaagagtcagtgccgaaatagtgaccggacgccatatccggcgcactggacatcatgccccagtcggtatcgaaataggtaaattgcgacagcataggcgccactgtcacgaacagggctatcagaaacaggacaataagactggccaccgccgcacggttatgcataaagcgccgacgggcatcttgccaaaggctgcgaccttccacctccagcttttcactgaaattttccagcgtctcgctgtttttcttacttaacatcatcgcgagctccagtatcaatagcgaattttcgggtcgataacggcatagagcacatcgacaatggcgttaaataatatggtcagcgccccgactagaatggtcaaacttaacaccagcgagtaatcgcggttgagcgcgccattaacgaaaagctgcccaatgcccggtaagccataaatagtttcaatcaccattgagccggtaataatgccgacaaaggctggccccatataggataaaaccggcagcagcgcaggttttaacgcatggcggaagataattctgcgcatcggtaatccttttgcccgcgcggtacgaataaagttcgaatgcagaacttcaatcattgagccgcgcgtaatacgagcgatgctggcaatataggccagtgaaagcgcaaccatcggcaggatcataaattttaacgccccgccgttccagccgccgccaggcagccattgcaaggttatcgcaaagaccatcaccagtagcggcgccaccacaaaactggggataacgacgccggtcatggcaaatcccatcaccgtataatcccatcgcgtattttgctttagcgcggcaatcacgccagcgctgacaccaataatgaccgccagcaaaaaagcggcggcgccaagtttcgccgaaacggggaagctggcggcaaccagatcgttgaccgtgtaatctttatatttaaacgatggtccaaaatcgccatgcgccagctgcttcaggtagctgaagtactgcgtcatgatgggatcgttcagatgatattttgcttcaatattggccagcacttccggcggcaatgcgcgctcgccggtaaaaggactccccggcgcgaggcgcatcataaagaaagagatggtaataagaataaacagcgtcggaatcgcttccagacagcggcgtaaaataaatttcaacattgcccgtaccttctggcctgtgcctttacttcccggacgtgacaaaagatccgccagggaaagttatagtgcgatgaaaaaagacaccatgggacaaccgcagttgtcccatgtcttgccattaatgtttgataatatataagtttttcacataaatattatccagcgggtctttaccggtatacccgcccacccagggtttcaccaggcgcgcgttaacgtagtaatacaccggcacaatagccgagtctttatctaactgctgctccgctttagcgtagagttcgctgcgctgcgtatcgtccgccactttcagcgtgtcggcaatcagcttatcaaacgccgggctcttataatgcgcggtgttatttgaactgtcggacaacatggtattcaggaacgaggtcggttcattataatctgcgcaccacccggctctggcaacatcaaaggtgccctgatgacgggtatccaggaaggttttccattcctgattctccagattcacattgacgcccagatttttcttccagatagacgccacggcaatggccagttttttatgcagatcggaggtgttatacagcaggtcgaatgttaagggcttatccgccgtaaagccggcttcagccaacaatttcttcgcttcttcattacgcttttgctgggaccatttgaaccactcaggctctaccagttttgcgccatcggtatacggcggcgtgtagctataagcgggtaaatcgccctgatttttaaccttattaacaataatgtcgcgatctaacgccagtttcagcgcggtacgcacgcggacatcgttaaacggcgctttttgattattaatttcgtaataataggtacacaaataagggtctacgcggacttcattcgggatctctttcttcagtttctggaataattcgatcggcatattgttataagtcatatcgatctcgccgctgcggtagcggttgacatccgtcacctccgaagagataggcaaataagttacctgattgatgacggttttggcgttatcccagtattgcgggttacgctccagcacgatacgttcgttcaccacccagttttttaacttataagcgccgttagtgacaatattggccggttgcgtccatttatcgccaaatttttcgaccgctgatttcggtacaggagacactgaagggtggaccaacaatttgtagaaataaggcaccggctcacttaaggtcacttcaaaggtgtgatcatcaagcgcttttacccccagatcggtggcgggttttttaccggcgataatgtcatcgatattagcgatatgaccgtattgcagatagctggcgtacggcgatgccgtattaggatcggccaggcgttgccagctataaacgaaatcatgggcggtgacgggcgtaccatctgaccatttcgcattttcacgtagatggaatgtccagactttaaaatctttattttcccatttttccgcgacgcccggtgaaggatgcccctcgacatcactaattaataagccttcgaagaggtcacggctgacgttcgattccggcacgccttcaattttatgcgggtcgagagactgcacttctgatccgttattacgtaccaacgtttgcttgtcggctaactgaacgccggcgggcacgtctgccgcagtcgcggcgctggcggcgatgagcgcagtgagtattcccgctgcaatcaaactttttttcgtgatgttagacattgtgtttgtactccactcattataattactggtttttaccagcctgtttaatcccgtcagggttcctgtgcagcactggtggtgtactgccaggtctgtcactgcttttgctatcaccgactttatttattctgacgattcgttcgatcgcctttcgtcgattcagtatacgacgtacctgcccacgtcgcacgttatttctgacaaccatctaaatgaaaatacttatcaacaatgtgaaatcttctacaaaaatgtttggccgaaaagtatcaaatgcgtttctgaaccgccaattcattttacaattttgttaaccaattctcttttatggaaaaatccctgcccaaaaaaacagttaaacaatgttaaaaatctttgatttattctttataatcaataagttgaaagaaaaatatctctctgtcgcatcgtaggttatgcctgcgccagaaaacacacacaaatttaacaaatgctcattatttagcacattcatctacgatggagctgaaacaactaataacatttcaataatccttcatcaagccccagagtatggtgtgaataaaataacagacctaccgcctctcacggtctcagtaatgttgataatagtttgattaataaaaataaatagcgttagattatattagtattttttatcatttaaacgctgaatgcttatcaaagtaagaagtgttacgtgggaatgtcacaaggcggccccttagggcgccgcctgtaaatcagcaggtgggagtttagttgagcaagccggggaaaatgccttttattcctgtgacaataaattcgatgccgagcgccattaacaacaaccccatgattcgggtaataacgttgataccagtttgccccagcaaacgaaccagccacggcgccatacggaacacgccccagcagcaaagcgcaaaaagcgcaatggcaactgaaaagccaagcaaatgcgcgatgctgtgataacgcgtcccccagacgatagtggagctgatcgcccctggccccgccattaacggcagcgctaacggcacaacgccaatgctctcgcgtatggccgtctctgacttttcttgcttgttttgtttatcttcccccagcttcccgctgatcatcgacattgcaatggtgacaaccaggataccgcccgcaattctgaacgaatcaatagaaataccaaagagttgcaggatgccatcgccgaggaataaggaactccacaagataatcgcaaccgacagattcgcggtgaggttagttttattacgcgccgtggccgtctggtagctggtcatgctgatgaaaacggggataatccccaccgggttaaccagcgcaaagagcccgataaagaacttaaagtaaacaggaaaatcaaaaagcggttgaatcacggttagctccgaagcgttagccggatgaagtcaatgttcgttaatgatcaaaacgcgcagaagatacgccttttattcgcatagttcacctcttatctacgcctaatttcatccattcatcgctgttatttatatgtactcgttatgctaatccactcactcttcatgataacgatttcttaacaatttacataaaaggctaaaatggcctgctgaaaggtgtcagctttgcgtaatcttgatttagatcacacaatcgctactcagaagtgagtaatcttgcttacgccacctggacgtaacgcgttagagttaaatgatactaacgcagaagctcttttagtaaatcagagcgaaacggacgttaagtaaccacctgaatttcaggcatttatacaaagtatcgtcgatctgtctatactcacgtatcgcgcagatgatttactaaaaaagtttaacattatcaggagagcattatggctgttactaatgtcgctgaacttaacgcactcgtagagcgtgtaaaaaaagcccagcgtgaatatgccagtttcactcaagaacaggtcgacaaaatcttccgcgccgccgctctggctgccgctgatgcccgcattccgctggccaaaatggccgtcgccgaatccggtatgggtatcgtggaagacaaagtgattaaaaaccacttcgcttctgaatatatttacaacgcctataaagatgaaaaaacctgcggcgtgctgtctgaagacgacaccttcgggaccatcaccattgctgaacctatcggcattatttgcggtatcgttccaaccactaacccaacctctaccgcgatcttcaaatcgctgattagcctgaagacccgtaacgccatcatcttttctccgcatccgcgcgctaaagaagcaaccaacaaagcggcagacatcgttctgcaagcggctatcgctgccggcgcgccgaaagatctgattggctggatcgatcaaccttccgtagaactgtctaacgcgttgatgcaccacccggatattaacctgatcctcgccactggcggtccaggcatggttaaagctgcatacagctccggtaaaccggctatcggcgtaggcgcaggcaacactccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccatggcggctacatgctgcagggccaggagctgaaagcggttcaaaacgttatcctgaaaaatggcgctctgaacgccgctatcgtcggccagccagcctacaaaatcgctgaactggcaggcttctccgtaccagaaaccaccaagattctgatcggtgaagttacggtcgttgacgaaagcgaaccgttcgcacacgaaaaactgtctccgactctggcgatgtatcgtgcgaaagatttcgaagaagcggtagaaaaagcagaaaaactggtcgctatgggcggtatcggtcacacctcctgcctgtacactgaccaggataaccagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctctgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagcagacccgacgctttccgttgttcgcaaaggcgctgagctggctaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacgatgcaaccggtcagaaatatccgctggctgactacgccctgaccccggatatggcgattgtcgacgccaacctggtgatggatatgccgaagtccctgtgtgcgttcggtggtctggatgcggtaactcacgctctggaagcttatgtttccgtactggcttctgagttctctgacggtcaggctctgcaggctctgaaactgctgaaagaaaacctgccggcgtcttaccacgaaggttccaagaacccggttgcgcgtgaacgtgttcacagcgccgcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgctgctaagattgaaaaactgctggcatggctggaaagcattaaagctgagctgggtattcctaagtctatccgtgaagcaggcgtacaggaagctgacttcctggcacacgttgacaaactgtctgaagatgccttcgatgaccagtgcaccggcgctaacccgcgttatccactgatctccgaactgaaacagattctgctggatacctactacggtcgtgatttcaccgaaggtgaagttgcagcgaagaaagacgtcgttgccgcaccgaaagcagagaaaaaagcgaaaaaatccgcttaattcgttatctgttttagcatgacaataacggcctcaattgaggccgtttttttgttttacctgtttatctgatgcctgaaggcgctatgctgatcatctggcctacgtgctcacggcacgcccttcgtcaggaggcctgaataatgacctccaaagcgctacagggcgttttataagccgctctttacctcaggtatcatatgtgccgatgacgctcctgaatcgccgtcagtgagccctcctccagcgcgtccttataatgcttacggcaaactgaaacgtagcgttcattcccgccaataaccacctgttcgccttcgttataaggcctgccgtcctgatcaaggcgcagaaccatactggctttacgaccgcagaaacagatagtttttaattccaccagcttatctgaccatgccagcaagtattggctgccgacaaagagctccccacgaaagtctgttcgtagcccatagcaaagtactggaatatctaatttgtcgacaacctcggataattgataaacctgctggcgagtcaaaaactggctttcgtcgactaacacgcaatgtattgtctgccgcgcgctctcggcacgaatctcttcaaacaaggatgtattttggttaaacaattttgccggcgacgacaaaccgatacgagagctgactttgcctgcgccgaaacgatcgtcgatttccgccgtatatacgacggtacgcatcccgcgttcctgataattgtatgaagattgcagcagtgcagtcgacttacccgcattcattgccgaatagtagaaatatagctgtgccattggtcgcaggacctcacctgagtgaaataaagattggcgggattgtaccataatttaccgacgcgacggcgcggctcgcgctccggtgagtattaagaattgtacaaacatcgctcactatacccaaaataattcgcgttgcttaaaggcggcaagggagtgagtccccaggagcatagataactatgtgactggggtgagcgagcgtagccaacacataagcaacttgaagtatgaagggtatatacacattccttcacaaattatgccgttaaaattcatcaacaatgcttatcatcacccgccaatatgaaaaccttgtacttattgttaccgttactcatacccggtgcaaagtaatagggttttcttgtaaggaaagctaatacaagagattgatatctctgcaatgagatcgtatttcatcatgataaaatgtgacctgactcctaaatttttagcgacagacggtgagtatcccccctgccaataagctcttttttgtgcggtgcctcaaggaaaatttaagttgagataattaaaacgtgtgcttaataaagcgtaattttgaattccttacattcctggctattgcacaactgaatttatcgctctattattagctcaacaaaccaccccaatataagtttgagattactacaatgagcgaagcacttaaaattctgaacaacatccgtactcttcgtgcgcaggcaagagaatgtactctggaaacgcttgaagaaatgctggaaaaattagaagttgtcgttaatgagcgtcgtgaagaagaaagcgctgctgctgctgaagtggaagaacgcactcgtaaactgcaacagtatcgtgaaatgttaattgccgacggcattgacccgaatgaactgctgaatagcatggctgccgctaaatccggtaccaaagctaaacgcgcagctcgtccggctaaatatagctatgttgacgaaaacggtgaaactaaaacctggactggccagggtcgtacaccggctgtaatcaaaaaagcaatggaagaacaaggtaagcaactggaagatttcctgatcaaggaataatttacttcctggatgcttaaaatcccgccgctggcgggattttttttgcctgagttctccgctgacgaccccaggcataaaaaaagcgccggatttaccagcgcttctgttaaaaaatttataacgtatcgttacttcttaatacccatttcttcttcaagccaggctttaaattcagcacccagcgaattatgacggatgccatattcaacgaatgcctgcatatatcctaacttattaccacagtcatggcttttacccttcatgtggtaggcttcaaccgtttctttttcgatcagcatatcgatagcatcggtcaactgaatttcatccccggcgcccggaggggttttcgccagcaacgcccagatatccgcgctcaacacataacgcccgacaatcgcaaggttagacggcgcgacatccgcttttggtttttcaaccacgccaaccatcggcacactttcgcccggcgccagctcaacgcctttacaatcgaccacgccgtatgcagtcacatcttctaccggctcaaccataatctggctattgccggtttcgtcaaaacggcggatcatttcagccaggttatcctgagacaggtcggactcatattcgtcaagaataacgtctggcagaataacagcgacaggttcgtttccgacaacgggatgcgcgcacaatacggcatggcccaggccttttgccagcccttgacgtacctgcataatagtgacatgcggagggcaaatagactgaacctcctccagaagctgacgcttaacgcgtttttccagcatcgcttccagctcaaaactggtatcaaagtggttttcaatagagtttttagacgagtgcgtaacaagcacgatttcagtaatgccagcagcgatacattcgttcacgacgtactgaattaatggcttatcaaccagcggcagcatctctttcgggatagctttggtcgctggcagcatcctggttcccaatcccgcgaccgggataacggcttttttgactttcgaattaagggcagccatttaaaattctcctggactgttcatgtattgaacgtgttcattaatctgtatcgtgttccagtatatcagtaccagaacaagcctcaggtccaaaaaggacttatattggtataattaagacaaatacttataaatctgccgcagatagtaacactcgtcgggaaaggccggtaaagcaatttccgctcactcttccgtttggtcattccgcagacaacatcaatcgcagacgccctcctgcgccccatatttgacactgccacgagtcgcaacgctggcttaattggttaaggtaggcgttacccaatgttcctagcggcacgccgctgctaatttgaacctgatgagcgcccgtatttaaggtggcgttcaatccggcggagacgagaatcaaatttttgagctcactgtgatagtagccgacaaatagcgggaattgcccaggtaaattggcttgtctgagcagatgatttacctgttttaatagcgcgcctaactccggtaaacggtgcttttgttggcctagctgatcctgcaataagccgttaaatagcgcccgcagcaacaatgcggctaacacgccgttatcgcccgcccgggtgacatccaggcaataaaatgccagttcgttatcagatagcggcgcaatatccagcaccagtccaggctgatcggcggagacgagctgccggtaattaatgcggcaatgagaaatcacctgctgtaccgggggctgcaattcctgcaacaattgcgctgcggcggtcggattactcaccattgcatcccagtcacgaaacaggcgttcttcttcttcaacccgcgagttaaacatattagggtataagcaagcgaatacggtttcccgcaagcggttgagatcttttaccggcttcagcaagacatcttcaaccccaaggcgcaacgctttggcgatatccgccatattttctgttgcggaaataaccagaataggcgtctggtctccgcgattacgtaagttttctaccagtttgagaccgttcattctcggcatagcgatatcacatatcatgagatcaggggtaaaacgccccatcaactccagggcatccaccccgtcgcctgccaatgccgttgtcgctcccaaagaggaaaaccacgaatccagaagcgagcgaaatacaggctcgtcttcaacaataagaatctgttttccgaccaatggctacgtcatgttctctcccctgactggctttaatcaatagtggcatggtattgccgcttgcgcctgtcagaatttgcttaagtgatcgtaaaaggtacattaaacgtcggtacgcaccaagggtataagttcgtccatctttttctctacggctaactgacccgccgcaatagcggcatgggcgcgatgaaaatccagcgtagagatttgcggacagaatggttgaatgagaatatcaggcggatcgccagccatacggttacgtttaagacgattttccaacacctggatggaggttgtcatgatttccattgccccaggcgaactcacgccacggcgtgaagtcaggctactgaaacgttcttttaaacgcttatgccagggcagcgcatcatcgctctcttcattgatattcccgacatttacagagagcaaatcttgctgcatgaggtgggcatcatgttgcaggtctaccgcaataacgatatcagcccccagcgccctggttaacgaaacaggtaccggattaacgactgcgccatctaccagccagtaaccgttatgttcaaccggagacatcagccctggcatactgcacgacgcgcgtacagcaaggtgtagatcgccttcagtaaaccatagctctcgtcccgtgctaagattcgtcgcgaccgcgccaaaacgtcttgaacagtggtcaaaatccgtgacgggcataatatcccgatagtgattaaatacgcgttcgccgcgaagcaaccctcctctgccccaggatacatccatcaggcgtaaaacatcccagtagcggaatgaacatacccactgttcaagcgccgataatttattacaggcatacgcggcgccgaccagtgaacctattgagcatcctgcaacgatatcaatatcaatgcctgcttgcttgagggctttgatgaccccaatatgagaccatcctctcgctgcgccagatcccagcgccagccctattttcatttttctcatcgtacttaacgacttcccctggcttcaagacgtagcaacatcgccactgctcagttaacataatgccaccctggcgttcaacgccgttttttatattcagggagattattgtgtctcagccttgtccctgtggtagcgctgacgagtatagcctatgttgtggtcgtattgtgtccggagaacgagtagcacccgatccgtcacatctcatgcgctctcgttactgcgcttttgtgatgaaagacgcagattacttaattaagagctggcatccaacctgcaatgcggccgcgtttcgtgatgatatcatcgccggatttgccaataccaggtggctcggcctgactatttttgaacatacctggtcagaagcagaaaatacagggtatgttagttttatcgcgcgtttttccgaacaagggaaaaacggggcgattatcgaacgttctcgttttatcaaagaaaacggtcagtggtattatattgacggtacccgcccgcagttgggtcgaaatgatccctgcccgtgcggttcaggcaaaaaatttaaaaagtgctgcggccagtgacgcctgacagtatcgatacagcaaacactctcaacaggatttttccggcaatgcaatcactacaacgtaaagttctgcgtactatttgtcccgatcaaaaaggccttatcgcgcggattaccaacatttgctataagcatgagcttaatattgtgcaaaacaatgaatttgttgaccatcgcaccggacgcttttttatgcggaccgagctggaaggcatcttcaatgattccactcttctggccgatctggacagcgccttaccggaaggctctgttcgtgaactcaatcccgccggacgccgtcgggtagtgattctggttaccaaagaggcgcattgtctgggcgacctgctgatgaaagccaactatggcgggctggatgttgaaatcgccgcggtcattggcaaccatgaaacgttacgctcgctggttgaacgttttgagatccctttcgaactggtcagccatgagggattaacgcgtgaagagcatgacacgaagatggcggacgccattgatgcccatcaaccggactatgtggtgctggccaagtatatgcgtgttttgacgccaggttttgtggcgcgcttcccgaacaaaattatcaatatccaccactcattcctgccggcgtttatcggcgcgcgtccttatcatcaggcctatgagcgcggcgtgaaaatcatcggcgctaccgcgcactatgtgaatgataatctggatgaaggcccaatcattatgcaggacgtgattcatgtcgatcacacttacaccgcagaagatatgatgcgtgccgggcgcgacgttgagaaaaacgtattaagccgcgcgctgtatcaggttctggcacagcgagtctttgtttacggcaatcggacgattattctttaatcgtcagtaatatgaattgattagctttaatccgttacggatgaaaagtacgcaaacagttcatttcaggcaaaggaatgctttacagcggcgtgtcatttgatatgatgcgccccgcttcccaaaaggaagcgggccagtattaagcattaccccgtggtggggttcccgagcggccaaagggagcagactgtaaatctgccgtcatcgacttcgaaggttcgaatccttcccccaccaccattattcactacagcgatgtagttaactcgatgagcaatgcagaagtttgcacttgtcggggaagggtgagaaccttcgattaaggttcgactcgagcgaaagaacgttgccaacggtaacggcccgtagggtgaggagtgaagcgacgaataatccttcctccaccaccatcttcaagctttacctacaatttgaattacccctggtggggttcccgagcggccaaagggagcagactgtaaatctgccgtcatcgacttcgaaggttcgaatccttcccccaccaccatcgcttccgtcgcgtatcttatccccgttaagcatagtgtctcatatctctctgtacgggaaggatgagaagcttctaccagggttcgattcgagcgcagcgagaaagcgttgccgcaggcaacgacccgaagggcgaagcgcgcagcgctgagtcatccttcccccaccaccatcactcccgtcgcgtatcttatccccgttaagcacactgtctcatatctctccgtacgggaaggatgagaagcttcgactaaggttcgattcgagcgcagcgagaacgcgttgccgcaggcaacgacccgaagggcgaagcgcgcagcgctgagtcatccttcccccaccaccatcactcccgtcgcgtatcttatccccgctaagcacagtgccttatatctctctgtacgggaaggatgagaagcttcgactaaggttcgattcgagcgtcagcgagaaagcgttgccgcaggcaacgacccgaagggcgaagcgcgcagcgctgagtcatccttcccccaccaccatcactcccgtcgcgtatcttatccccgttaagcacagtgtctcatatctctctgtacgggaaggatgagaagcttcgaccaaggttcgattcgagcgcagcgagaaagcgttgccgcaggcaacgacccgaagggcgaagcgcgcagcgctgagtcatccttcccccaccaccataatctcccggcagcgcctcaatcaatcttcatcgcccccacaggcagacttcactccatggcgccatggcttattggttatcttatcaatacttcttcctggcaatctttttcgcctcctttgactgatcaatttttcgccagatgagattaaaggcggcatatgtctcgctaagttgatctggggtgagcgttcccttgagtcggtttctttcggcaatgagcgctgaacaatcatccttagatttttccgtatacatacttgccatgtaataccaaatataggcctgcttattatctttaggcacaccctggcgcccatgagcataaatttccccaagcgctgattgtgccggagtaaacccctgctctgccgctttgaggtaccacttcagcgcattccggctattttcaggcacgcctcttcccgtgctatatgctacgccaagctgatattgcgctttcgcaaaatcctgttttgctgcttttcgataccatgcgatagcctgtctgtcgctttgcgcgacgccgcgaccaaatgcagacatgatgcccagatgcgtttgcgcagcaggcagcccctggcgagcggctttgcgataccacgccagcgcctgttggtagtcctgagaaacgccctcaccctgcataaacatcacgccgatcgcatcctgcgcctcggccaatccttgcgctgcggctctgcgataccactccagcgccaggttgtgatctttcaataagtgataaccgttgtaataccatacgccaaaattgtactgtacctttgccatcacgcgttgcgctgtttttcgataccacgtctgagagtgaacccggtcagcgggatgcgctttatcatagagcgcattcagcggaatgtggcctggcgtatagctgcctggtataccttcattaagccagtaaactgcctgacgataatcctgaggcacgccttcaccataaaaataggcaacgccgagataaagttgcgcggggtagtacatattttccgccgctttacgcatcaagatcgccgtttgctgataatcctgaggaacgccctgaccgtgggcgtacattactccaagcttaaattgtgctgacgaagctgaaccctgtccgcggacaacgcccgcatcattggttggagaggcggcttttcgataccactccagcgctagctgggtattttggggaaacccatcgccatacatataggcgtcaccgaggatttcttgcgtactactatcccctagctctgccgccttgcgataccactccagcgctttttgtcgactaagtggaaaattttcaccatagttgtaatgatagccaaggatgaaataggaaaaatcagaaccttgtttacccgctttctccagccattttatggctagtttataatcaggcttaacgtatcgcccctccgcataccagcttccaagcgagaactgcgcgctttcatctccttgttccgctttttgctctaattcctgaacgtactggcattcttctgagtcggcgggatagcgctcctcgcagacagcagcgtgagccatttttgaaataaatatatttaatattattattttgaaaattgatgaaaaacgcatacaactatccttattgtcgtttatggcgtgattatatgctgcatcatcatttttctgcttacaaaaaactcgcacagatgctgaataaacccaaaaacaaagagtacggattcagatgccagacatggcagacccgctgtaaacgaaacaaggcggcggtcgataaggcatttatgccgcactccggcaaacagccataaaaaaactccgccgaagcggagtttagggcatcgagagaaaatcagtgacgtgcacgaacaatctggtatttgcgggtcagatactcgaccggcacgctccagatatgcaccaggcgcgagaatgggaacaacaggaacagcgtcatccccagtaccaggtgcatacggaagataaaggctacaccatccagatgtgcggatgcgccaccgtggaaggtcacaactgactgcgcccacccgaccagcttcatcatttcactcccgtccatatgctgggcggagaacggaatggtcagcaggcccagcgcgcactgaatcaccagcagcgagagaatcaaaatatctgcgccggtagtggtggcgcggacacgtgggctaaacagacgacgcttgagcagtaaaataccgccaaccagcgtcagcacgccgcaggcgccgccggcaatcatcgccatcttctgcttcacgtcgaccggcagaaaagcttcatacatccagtgcggcgttaacatgcccaggaagtgaccggcgaaaatacccagaatcccaatgtggaacaggtttgacgccaggttcattcctttgcgatccagcatctgactggaagccgcccgccaggtgtactggccgtagtcgtaacgtaaccaactaccgatcagaaataccgatccggcaatgtacgggtagatatcaaagaagaacatattcaggaagtgcattagtgctgtcctccggtggtgatattcagatattgcggcgccacggccccggcaaaacgacgctggtgagcggagatttccgactcgccacacccttgatcggcgaagaatttcacctgctcttcttcccagaccgcatccaacgcctgcggggtatcatcacgtgcttcattcgcaattttttcagccactttatcgctgtcgataacggtattcgccagttttaacagcagatcgaacagcaccgcataacggctgtcacgctgttgcaaacgtgcgctgagcagcgccagaatcggcgcgatatcctgtaaaccccctaacgcttcgcttttcggcaattgcgcaaggtattccagatacagcggcagatgatcgggaagttcgcgactgtcgagctgcaaaccgtgctgctcatactgtgccatcaggtcaaccatcgcctgaccgcgatcgcgggattccccgtgtacatgttcaaacagcagcagcgatgtggcgcgaccacggtcaaacagttcgctataagcggcctgtacatccagcaggtcctgcgcggttaaatcgcgcaggaaaacgcccagagtctgggcatcctctttatccaggttctcagatgacgcgagcgcatcgaacaactcctgctgatgctgccacagggcagcatccgggtactcgagcagacgcgaaacaatgacgagttcaatcatgcgtgcggctccgttttgctggtcacatcaacagcgtcgatgcggcggctgttgaacagattgaatttggtatcagacccgtggcaaccatcgccgaaggtaaagccacaaccgcttttctccgggaatgcgtcacgcgccagttcacgatggctgctcggcaccacaaagcgatcttcataattagcaattgccaggtaacgatacatttcctgcgcctgggcttcgcttaaacccacctcttccagcgcgcgggtatccactttaccgtctacggtttccgcacgtttgtagtgacgcatcgccagcatccgtttcagcgccaacagtaccggctgggtgtcgccagcagtcaacaggttcgccaggtactgcaccgggatacgcagactgtctacatccggcagaataccgttgctgccaagttcgcccgcatcggcggcagactgaatcggtgacaaaggcggtacgtaccagaccatcggtagcgtgcggtattccggatgcagcggcagcgccagcttccagtcaatcgccattttgtacactggcgattgctgcgccgcatcgatcacgctctgcggcacgccgtccttcagcgcctgctcaatgacagccggatcgtttggatcgaggaacacgtccagttgacgctggtacagatctttttcgttttccgtactggcggcgctttcaatggcatcggcgtcatacagcagtacgccaagataacggatacgacccacgcaggtttccgagcaaacagtcggctgaccagcttcgatacgcgggtagcagaagatgcacttctcggacttgccgctcttccagttgaagtaaatcttcttgtacgggcagccggtgatgcacatccgccagccgcggcacttgtcctggtcgatcagcacgatgccatcttcttcacgcttgtagatagcaccgctcgggcaggtcgccacgcacgccgggttgagacagtgctcgcacaggcgcggcaggtacatcatgaaggtgttttcgaactggccgtacatcgccttctgcatgttttcaaagttctggtctttagcgcgtttttcgaactcgccgcccagaatctcttcccagtttggcccgctggtaattttgtccatccgctggccggtaatcagcgagcgcggacgcgcgatcggctgatgtttgctttccggcgcggtatgcaggttctggtagtcgtaatcaaacggctcgtagtagtcgtcgatgcccggcagatgcgggttagcgaagattttacccagcagcagcgcccggttgcccatgcgcggctgtagcttgccgttaattttgcggatccagccgcctttccatttttcctgattttcccagtcattcggaaaaccaacgccaggcttactttctacgttgttgaaccaggcgtattccataccttcgcgactggtccagacgtttttacaggtgactgaacaggtatgacagccgatgcacttatcgagattcagcaccatgccgacttgtgaacgaattttcattttacgctctcctgtacctggtcattgccttcgccatccaaccagttaatgttcttcatcttacgtaccaccacaaactcatcgcggttggagccgacggtaccgtagtagttaaagccgtaggctaactgcgcatagccgccgatcatatgggtcggtttcggcgtaatgcgcgtcaccgagttatgaataccgccgcgctgctgggtaatttccgaccccggcaggtttacgatacgttcctgcgcgtggtacatcatggtcatgcccgccggtacacgctggctgaccactgcgcgtgcggtcaatgcgccgttgctgttgaagacttcgatccagtcgttatcttcaatgcccagatctttggcgtcggtttcgctcatccatacaatcgggccgccacgcgacaaggtcagcatcaacagattatcgctgtaggtcgagtggataccccatttctggtgcggcgtcaggaagttgagcgccttctccggattaccgttggatttacgccccatcaccgctttcaccgagcgggtgtcgatcggtgggcgatacaccagcaaactttcgccgaagtcgcgcatccactggtgatcctgatacaactgttggcgaccagacagcgtacgccatgggatcagctcgtgaacgttggtataaccggcgttataagaaacgtgctcatcttccagaccagaccaggtcgggctggagataattttgcgcggctgggcctgaatatcgcggaagcggattttctcttcttctttattggttgccagatgcgtatggtcgcgaccggtaaactcgctcagcgccgcccaggctttcaccgccacctgaccgttggtttccggcgctaacgtcaggatcatctctgccgcgtcaatcgccgtgttgagcatcggctggcctttcgccggaccgtccgctttggtgtaattaagcttacgcagcaagtccatttcgctctgcgtgttccaggcaatccctttcccgccgttgccgattttctccatcagcgggccgatagaggtaaagcgttcgtaagtcgccgggtaatcgcgctcaacggtcatgatgtgcggcgcggttttccctggaatcagatcgcattcgccttttttccagtctttcacgtccagcggctgcgccagttcagcggcagaatcgtgctggatcggcagcgtcacgacgtcagtctctttacccaggtggcctacacagacttcggagaatttcttcgcaatgcctttgtagatttcccagtcgcttttcgattcccaggccggatctacggcggcagacagcggatgaataaacggatgcatatccgaggtattcatatcgtctttttcataccaggtggcggtcggcagtacgatatcggagtacaggcaggtgctcgacaggcggaagtccagcgtcaccaccagatccagtttgccgtccagaccattgtcacgccactccacttcttccggcttcacaccgccctgtttacccagatccagcccctgaataccatgctcagtacccagcagatacttcagcatgtactcatggcctttaccggaagacccaagcaggttagaacgccagatgaacaggttacgcgggtggtttttaccgttttccggctgctcggcggcaaagcgaatcgaaccctctttcagggatttgacggtatagtctaccggcgtcataccggctttttccgcttcacgcgcaatatacagcgggttagtgcctaactgcggcgccgacggcaaccagcccatacgttcggcgcgcacattgaagtcaatcagatggccgctatagcgggatttgtccgccatcggcgacagtaattcctcggcggtcaccgtctcgtagcgccactggctggagtggttatagaagtaagaggtgctattcatgtgacgcgccggacgctgccagtcaagggcaaacgccagcggctgccagccggtctgcggacgcagtttttcctggccgacgtagtgcgcccagccgccgccgctctgaccaacgcaaccacagaacaccaacatattgatcagcccgcgatagttcatatcgaggtgataccagtggttcagaccggcgccaacgataatcattgaacgcccgtgcgttttgtccgcgttatcggcgaactcccgtgcgatacggatgatctgcgcccgcggcacgccggtgatctgctcggcccatgctggcgtatacgctttggtatcatcataactggcggcacaattttcatcgttcaggccgcgttccagaccatagttcgccatggtcaggtcatacacggtggtgactaacgctgaagaaccatcggccagttgcagacgttttgccggcagtttatgcagcaggacgttatccagcgccacatgattaaagtactctgaaccctcgccgccgaaatacgggaagcccacgtcagcaatctcatcctggctgcccagcaagctgagctgcaattcagtttctgcaccggtagtcccgtcgcgctgttcgaggttccatttgcctttttcgccccagcggaaaccaattgaaccgtttggcgctaccatttcaccgttgctgttgatagcgacggttttccattccgggttattttcctgccccagcgaatcaacgagatcggcagcgcgcagcatacgacctgcggcataataaccatcacgctcttcaagcatcaccagcattggcatgtcggtatagcgacggacataatcggtgaagtactggcgcgggttgtcgaggtggaactcgcgcagcatgacgtggcccatcgccagcgccatcgccgcatcggtcccctgcttcggcgccagccacagatcgcacagtttggcgatttcagcatagtccggcgtcaccgcgacggttttagtgcctttgtaacgtacttcggtaaagaagtgggcgtccggcgtacgggtttgcggcacgttagagccccaggcgataatatagctggagttgtaccagtcagcggattccggcacgtcggtctgctcgccccaggtttgcggggaggctggcggcaggtcgcagtaccagtcgtagaagctcaggcaggtaccgccaatcagcgaaagataacgtgcgccggaagcgtaggaaaccatcgacatcgccgggatgggtgagaagcccgcgacgcggtcagggccataggttttcacggtgtacacgttggaggcggcgatcagctcgttcacttcctgccatgaggagcgaacaaagccgccacgaccacgcgcctgtttgaagcttttggctttatcggcatcttcaatgatggaggcccatgcctctaccggatcgcgatgcagttttttcgcctcgcgccacatcttcatcagacgtttgcgcattagcggatatttcagtcggttagcgctgtagagataccaggagtagcttgccccgcgcgggcagccgcgaggttcatggtttggcatgtcaggacgggtgcgcgggtaatcggtttgctgtgtttcccaggtcaccagaccatttttgacataaattttccagctacaagaaccggtgcagttcaccccatgggttgagcgcacaattttgtcatgctgccaacgttggcggtatccgtcctcccagtcccggtttgtttcgagaagctggccgtgcccatcggcaaaggtttcgcccttctgcttgaagtagcgaaaccggtccaggaatttactcatcgggtttctcctgtgtggaaccttacggctctctgataaatcgacattgcttaactaagggcgaaggtaacgcgctgaatgggcgtgagaattgataacgatcaaggcggacagggatgcaaatggcgcgcaaacctcctgcatactcctttgggaggaggagttttatttatatatattactgatttaattacataaaattaaatttacgcacgacatgaatgttaaattttcaacaagtgggtattaaggggtatccccctggatgaccgataaagatgtgcgtggttagccctgccgcgtctctcttcttgattataagtatgttgtaactaaatacagataaaaaaaagcgcggtctaacgccgcgcaaaggataatcaaaagttactttttatttttagaatgacgtccatataccgcccaggtaataacgacgcaggcgatatagaaaataagaaagactttcatcgcgccgactggagaaccggttaatgctaaagatgaaccaaacgctttcggaataaaaaagccgccaatcgcgccaatcgcggaaataaagcccagcgccgccgccgtatcagttgccgcttcacgcatggctctttcttccgacccgccttccgcttttacccggtccattgtcagtttacggaagataacggagatcatctggaaggtagaaccactccccaacccagccgtcaggaacagcgccagaaataccccgtagaacgcgataaagctaccgccaacgccgccagtaggtaatgtcaggaacagcagaccgctgaaaatcgccatcaggacaaagttgataagcgtgacgcgagtcccccccagacggtcagaaattgcgccgcctgccgaacgcgccagcgcgccgataaacggaccgaaaaacgcataatgcaggatctgcacatccgggaattgcgttttagacagcatcgcgaaccccgcggagaaaccgataaacgatccgaaggtcgccagatacagcagactcatgatccacagatgaccacgtttgagcaccggcagttgctcttttagcgaggccttagacgtcgccagttcgttcatgccgaaccacgccgccagcgtaaaaatggccaggaaaggcacccaaatccaggccgcgttcgccagatagagctgagaaccgtccggctgctctacaccgtggctgccaaaggcggcaaagatagagagcgaaaccaccagcggcgcaaccagttgcatcacgctcacgcccatattgcccagaccaccgttcagacccagcgcgccgccctgcttttgtttaggaaagaaaaagctgatgttcgccatactggaggcaaagttcgcgccggcaaaaccacacagcaaggaaataataatgaaggtgctaaatggcgtactggtatcctgaacggcaaagcctaaccatacgcagggcacgatgaggataccggtactgaacgctgtccagcgacgtccgccaaatagcggcaccataaaggagtaaggcacccgtagcagcgcgccggaaacagatggcagcgcagtcaacataaagagctgatcggtcgtaaaattaaatcccactttcggcaggttcaccgccactgcgctgaatagcatccagacgcaaaacgccagcagtaaacacggcacagaaatccacaaattacggctggcgacacgatggccgcgctgctgccagaatgccggatcttccggacgccattccgtgataacagcgccagttgccctttccggggcggataagtgactcatagacacctctgattcttgatttgatgtctgccacattagggtttactgccgaaggtaagttgatataaatcaaaggaaaagtcgtcatcaccggcgactaaaaatagttattacccttaatgagtaggctattttggtaaaaaagctgtggtttttcaccatgctgtgtctgtctactccttcccgtcgcagatacctctctacagcggcaattaaggagtaactcgttataggtatgggtatactccgctgtatcgttgagaatagcggcacagccgattgacgcccctcttttttgctacgttttttcggcgacattaccccgaagaaagaaggtaacatgtttaaacggtgtttctctcctcttacgctggttaaccaactggcgctgattgtcatgctctctaccgctatcggcgtggcggggatggcggtttccggctggctggttcagggtgtgcagggtagcgctcatgcgattaataaagcgggctcattgcgtatgcaaagctatcgactactggcagctgtcccgctggatgctaaagatcaaaagctgctggatgagatggagcaaacggcattcagccctgaactgacccgcgccgctgagcgagacgggcagcagaagcagcttaaagcgttgcaggattactggcataacgaactctcgccagggctacagcacgcgcaaaacgcgcacgcggtcgcagaagatgtcacgcgctttgtggcgggcctggatcgcctggtgacgtcgttcgaccatacgactgaattgcgtatcgaacgcgtggtattagttcaccgggtaatggcgatctttatggcgctattgctggtatttacgattatctggctacgtgttcgccttttgcagccctggaaacagttgttatcaatggcgcgcgccgtcagtcagcgcgactttacccaacgtgccaatatcagtggacgcaatgagatggccgcgttgggttctgcgctcaataatatgtctgaagaactggccgaaagttatgcggtactggaacagcgcgtacaggaaaaaacagccggtctggaacataaaaaccagattctctcgtttttgtggcaagccaaccgccgactgcattcacaggctccgctatgtgagcgtctttcaccggtactgaatggcctgcaaaatttaacccagttgcatgatattgagctgcgggtctatgacctggaagatgaagataatcaccaggaatttacctgtcagtcggacatcagttgcgatgataaaggctgccacctttgcccacgtagcgccctgccgatgattaacggcggcaccaccttaaaatggcggctcaccgactctcacacccaatacggtattttgctggcgacgctgccctatggacgccatctcagccacgatcaacaacagttggtggacacgctggttgaacagcttaccgcgactctggcgctcgacaggcatcaggagcgccagcagcagttgattgtcatggaagagcgtgccaccattgcccgcgaactgcatgattctattgcccagtcgctctcttgtatgaagatgcaggtgagctgcctgcaaatgcagggcgacgtgttaccggaaagcagccgtgagttactcagccaaattcgcaatgagctaaactgctcctgggcgcaactgcgcgaactgttaaccactttccggttacagttgacggaacccgggctacgtccggcgctggaggcaagctgccaggagttcagcgcccggtttggctttacggtaaaactggattatcagcttcccccccgcctggtgccttcacaccaggcgatacacctgttgcaaattgccagggaagccctcagcaacgcccttaaacactctcatgccgacgatgtggtggtgacagtgacgcaatgtggcaaacaggtcaaactaaaagtgcaggataatggctgcggcgtcccggaaaacgccgaacgcagtaatcactacggcatgatcatcatgcgcgatcgggcgcaaagtttgcgcggcgattgccaggtacgccgacgcgagactggcggaacagaggtcactgttacttttattccagaaacaaacttcacagaaacccagggagatacccatgaataatcaggaaccggcaaccatcctgttaatcgatgaccatccgatgctacgcacgggtgtaaagcagcttgtgagtatggcgcccgatatcagcgtggtcggagaagccagcaacggtgagcagggtattgacctggcggaatcgctcgatcccgatctgatcctccttgatttgaatatgccgggaatgaatggtctcgaaacgctggataaattacgcgaaaaagcgctgtcaggacgtattgtcgttttcagcgtatccaaccatgaagaagatgtcgtcacggcgctaaagcgcggcgcggacggttatctgttgaaagacatggagccggaggacttgctcaaagcgttacaacaggccgccgccggcgaaatggtattaagtgaagcgttaacgccggtactggcggccagcctgcgggccaaccgcgccaccaccgatcgcgatgtaacgcaactcaccccgcgtgagcgcgatattctgaagctcatcgcgcagggattgccgaataagatgattgcccggcgtctggatatcaccgaaagtacggtcaaagtgcacgtgaaacatatgctcaagaaaatgaagctgaaatcgcgcgtggaggccgccgtctgggtacatcaggaacgcatcttttaattattgctcctggaacggttgccaatgcggattatcgtccggcatcgtgataaacggttcagtcagcgcgagcgtgatctcattggaagagacacgctgacctttttcatcctcaaccaccaccgataaacgccagcgatttgccgcgccttcgcggtgatcccaggccggcataatgattgtccagccctcggtactgcgggtgtccgttcctgccgtcaaacttaatgcctgtgtatcgccctgccagctcaaatgacgaataccgtgcacgctgcgcacctgcaattttaacgcaaccgtctcaccaggcgtaagatcccagggcggcgtcgccagaaaaaccgttaacgttttacgctgccgatactccattgtcggcagcgagttacgttgcggcgtatcatagcggctaccgcgtaatgactggctttgcgccacttcactggcggcaagctgctttttgagcggcacgccgaagcggtagttaagcgtcagccccaggttattttgactgaccccgctctcgccctgtttgtgctgggcggtcatggtaagcaaaggtactggcgtatagttgagacccagttttaacgcgacaggattgtgataccccgttccggagtcaaacagatccacgctatcgccaaagtactgctccagactaacgctggtattgatatgctggtaaaacggcaggcgcatttgcgcgttgatatcatatccgcgcgccattcgctgttctaaggtcgccgtatgcgtctgccagtcggcaaaaggctgataatagttggcggataaacgcaaatattctccccacgcctccgcgccaaagccggcgcgctgtagattttcatccagcagattatcgtaaaaggtattatagccaagaagccagccatcctgcgcccagcgctgtcctacgccaatgttgcttaccagtccgtcagtctgttgcgtaagaccaagctggctccaggtcagatagcgctgtttatcctgtaaagggataaaccagcttccgcgactgccgttaaaatgaccttcgttatcgacgttaatatccacgctggcgctgccccaggctgatagccagctttcaagctgctggttaacctgctcgctgaccacatcgcgtacctgtccgaaagcgaattgccgcgcctgttcaccagtatccagatcgttatttttcatgctggcttcgccaaacgctttggccatctcggcaaaatgcttttccccttcgtgggattccggcatcatgcctaaatccggcagacggttttgcgtgaaaggatcttgcgcctgcgcacggatcgtaccgctggcagccagcaagagaagcgagagtgagaatgaacgaaaaacaatacggctcaacgtgtcggcaacttctacaacaaaagataagaggaatgacatcagagtaaaccataacgtgtccggacaggttttgcagccttttctcgtgcttccaggaatatccttattttttccgcagagcgtcccgggattttatccacgcatttggcggtacccggttcccgaggtaacataacgccattgccgacaaaatttctcaaggagaagggttatccatgcaaaatatcgtcattatcgctaacggcgccgcctacggcagcgaatcattatttaatagcctgcgtctggccattgcgctgcgcgagcaggaaagccatctcgatttacgcctgtttttgatgtcagatgccgtaaccgcagggttacgcggtcaaaaaccagccgaaggctacaatattcagcaaatgctggaaattctgaccgcgcaaaacgtaccggtaaaattatgcaaaacctgtgcggacggacgtggtatcactcccctgccgctgattgacggtgtggaaatcggaacgctggtcgagctggcgcaatggacgctggcagcggacaaagtgctgacattttgaatctgtacgcgggaaaagctcccgcgtcaggatagacttccggcaagaaaatcaggctaacacgcgagtaataccgcgtttattttttcttatgccatttatcatcctcgcctttttcataatcgtttttaaccgccgcccaggcgactttgtgtgcggtttcctcgcggctggcgtcatcacgacgatcggctttatctttatattgctcccaggcgctattaaacgcttctttgtaaatgtcctgggcatgggctggaagaacattccgcacattatcgggtaaatcacttttggctttatacggcatcagcgcctccgtcttcagggaaaacattaagtgtggtaaacaatgcgttattacgccagtcgaggaggatttttgctttttacggaaattaactttttgttatttaaacactgttaaaacaagatgcttgttttactgaccttgaaagaaaaaaatcgtctacgccgtaaaactacgtaaaaaaccactaaaaaaatacaaatttctgctatttttaccttctttactctttccaaaatattaacacctgcacaagggagaccctcatgacacatgcctgtgaggcggtgaaaacccgccataaggagacttcgcttattttcccggttcttgcgctggtagtgctgttcctttggggaagcagccagtcactaccagtggttattggcatcaatatccttgcacttattggtattttaagcagcgcatttagcgtggtccgtcatgccgatgtattagcgcatcgactcggcgaaccctatggatcgcttattttaagcctgtccgtcgttattcttgaggtgagtttaatttccgcgctgatggctaccggcgatgctgcgccaacgcttatgcgcgatacgctctactctattattatgattgtcaccgggggactggtcggtttctcgttgttgttgggcgggcgtaaattcgcaacgcaatatatgaatttatttgggattaagcagtatcttatcgcgctgtttccgctagcgattattgtgctggtttttccaatggcattgccgcaagccaatttctctaccggtcaggcattattggtcgcgttaatttccgccgcgatgtacggcgtatttttgttgattcaaaccaaaacgcaccagagcttatttatctatgaacatgaagatgaaggcgatgatgacaatccacaccacggtaaaccctccgcgcacagtagcggctggcatacggtctggttactcattcatttaattgcggtcattgccgttaccaaaatgaatgccagcccgctggaggcgttgctgaccagcatgaacgccccggtcgcctttaccggtttcctggtcgcgctgttaattctctcgccggaaggactgggcgcgctgaaggcggtactgaataatcaggttcagcgggcaatgaatctgttcttcggatcggtgttggcgacgatttcattaaccgtgccggtcgtcacgctcatcgcctgggcgacaggtaatgatctggtgtttggtttaggcgcgccggaaatggtagtgatggtggcctcgttagtgctgtgccatatttcgttctctaccggacgcaccaacgtgctaaacggcgcggcgcatctggctttatttgccgcctatctgatgacgatttttgcctgatataaaaaagccggatagtatcttatccggcctacacaagctaaaaaccgcaatcagttctcggtatccagctcgtcgaagcttttcaccaaatcatcaatcgcttttatctgggtcaggaactgctccagtttcgccagcggcagcgcggaaggaccgtcgcacttcgcgttagccgggtccggatgcgactccaggaacaggcccgccagaccgacagccataccggcgcgcgccagctcggtcacctgaccacgacgaccgccagaggcggcgccaaatgggtcgcggcattgcagcgcgtgggtgacgtcgaaaatcactggcgagttgccggagacctttttcatcacgctaaagcccagcatatccaccaccaggttgtcatagccgaagttcgcgccgcggtcgcacagaatcaccttatcgttaccgccctcatggaacttatccacaatattgcccatctgacccgggcttacgaactgcggctttttcacgttaatcacagcgccggttttcgccatcgcttccaccaggtcggtctggcgcgccagaaacgccgggagctgaatcacgtcaaccacatcagcaacaggctgcgcctggctggcttcatggacgtcagtgatcacttttacgccaaatgtctgcttgagttcctggaagattttcatcccttcttccagacccggcccacggtaagagtgaatagaggaacggttggctttatcaaaagaggccttgaacacgtaaggaatacccagcttctgggtaacggttacgtagtgctcacaaatgcgcattgccagatcgcgtgactccagcacgttcataccgccaaacagcacaaacggcaggtcatttgccaccttaatgtcgccaatgttaaccactttttgtttcataggatcgccttacacttataggtaaaatgtcggttaattaatgtagaacaatttgcttgtgcgcaatggtgttgatctgcgcacgaatcatttcgctgatcgggtcttccggacactgttcaacgaagtagcttaaatcagtcagcgcaacgtgttcacactcaagctgcgcgtagatcaacccgcggtcacggatttcgtaaggatcttccgggttaaattgcaacaatgcttcgctaacgcgcagcgccagctccatttgccgttcctccatcagcgaggatttcagcgtatccagtagcttacgaatcacttcggcgttatccgcttcgtccaaatcttcattaaacaactcggcgaccggactaatattgccttttaaccagacttccagagtatgttcatcaagcgtttcaccgttgaacgggttaatcagccacatttccccttccagcgattcaatacgcaaaatcaactgcgttgggaagataacgggcaccaacggcaaatcaagacggtttgctatccataataaaatagcgcccaacgataccgcgctcccctggcgttttttcaggactttatcgagccataaagcatcagaaagacggtagacgccgcgggaatccgtgaacccccactcgccgtaaaaaagtgccagcaatttttccagttgctcatcctgagacaggagctggctaatttcttcctgcgccagactgaccagacgttccagttcgtcgtagacaaactgcgtgggaaaatccaggcgaatcatctctgatgccaggatcatgccatcacacagcggcgcattgttaaattcgaaatcagctaacgacctcatgacttaccccagtaacggtatttttgtggtggcgagtttaatgatgatgtacagcaccaccagcgccagcgggaaagcgataaaacgcgcctgctggctgcgcgcctgacgataatcaagcgcaataaaacccaaaacgatgtagatgataacgccaaacagtttttcagtcagccatgagcccgactccgtgaatggcaggatgtgcgttttaacgattaacccaataccgctaagcagtaacagggtatctatgacgggaggcacgattcgtgtccagcgcgcggcggccaacgcatggccgcaatagcgccaccagtaacgagcgacaaacaaactgacggagagcgcaacacagataagatgaagcgtgagcaacattgcaattgtcatggcgtaaaacgtccgcaggtcacgcgttcattaccaccataatcacgacacgtttctacatccgagtaaccagaccgcctgaaaaccgctcttaccgcttcgccctgctgccaaccgtgttccagcagcaggaagccgccgggcgttaacatctggcgggcgttatcgataatatgcgtaagatccgccataccgttttcgtccgccaccaacgctgagcgcggttcaaagcgtacatcgccttcgctaaggtgcgggtcctgcgcgtcaatgtagggcggattgctgacaatcatgtcgaactgctgccccgatagcgcgctgaaccaacaactttgcagtatacgcacattccggatagccaaatgttccgcgttgcgtatcgccagcgcaaccgcatcaggcatacgatcgaccgcagtcacctcgcaatccggtcgctcgcaggccagcgccagcgcaatcgcgccggttccggtgcctaaatccagaatacgacaggtttttaccggcaatcgcgccaacgcctgttccaccagacattcggtatccgggcgcgggattagcgtggcgggagaaacgaagagcggcagcgaccagaattcgcgtaagcccgtcaggtacgcaataggttcgccctgtttacgccgctgcagcaggtccgcgagctgttgttgctggacgtcggtaagcggcgtttcgccaaaggccatgatatacgtccgccccttgcccgtaacgtactctagcaggatctcggcgtcgcgccgggggctgtcgctgtcccggagctggtttaccgcctcatgcagccagtgctgaaaatccattattcctgctcggataaggcggctaacaggtcagcctggtgttcctgaacaatcggctcaatcagcatatccagcttaccttccatcgtttcatcaaggcgatataacgtcagattaatacgatgatcggtcacgcgcccctgcgggaaattataggtccggttacgatcgctgcgatcgccgctgccaagcagattgcgtcgcgttgacgcctcggcctgctggcgttttgccgtttcggcggcgtgaatgcgcgccccgagcaccgagagcgctttcgctttgtttttatgctgcgaacgctcgtcctggcattccaccacgatgccggtcggcaagtgggtaatacggatagcggagtcggtggtgttaacgtgctgaccgcccgcgccggaagaacgaaacgtatcaatgcgcagatccgccgggttaatatccggcagctcggcttccggcagctccggcatcacggcgacggtacaggcggaggtatggatacgcccctgcgactcggtcgccggaacacgctgtacgcggtgtccgccggactcaaatttcagtcggccatacacgccgtcgccgctgattttggcgatgatctctttataaccgccatgctcgccttcgctcatgctcatgatctccacgcgccagcggcgcgcttcggcataacgactgtacatgcggaacagatcgccggcaaacagcgcggcttcgtcgccgccggtaccggcgcgaacctcaaggaacgcgtttcgttcatcgtccggatctttcggcagcagcagtacctgtaactgttgctccagttgttcgcttttttctttcgcttcgcgcagttcttcctgcgccatttctcgcatttcaggatcgtcgagcatcatctgagccgtctcgatatcgtcctgaacctgttgccagtccgtaaaacagcgagaaacgtcgcttaattgcgcatattcgcgcgacaatgcgcgaaagcggtcctggtcggcgataattcccgcatcgcccagcaacgcctgaacttcctcatggcgttcgtgcagggcttccagtttggcaacgatagaaggcttcataggcgtaaattcaccctgtaaaaaagtgtggtgtgtgctgctactccagcccgaggctgtcgcgcagaatattcaggcgttcgtcatccccgtcacgggcagcctgttgaagtgatttcgttggcgcatgaatcaggcggttggtcagtttccatgccagatcctgcaagatggcttgcgcatcaccgccctgttgaagggccgacagcgctttggtagtcagttcgtcacgaatctgctccgactgactacggtattcccgaatggtctcgctggccccctgggcgcgtagccaggccataaactcgctggcttcctgctcaacaatcgtttccgcttctactgccgcagcctgacgctgcgccagattatgcgaaatgatgctctgtaaatcatcgacgctataaagataagcgttcgccagtttgccgacttccggttcaacgtcgcgcggtacggcaatatccaccagcagcatcggctggttgcgacggctttttaatgcgcgctccaccatgcctttaccgataatcggcagcgggctggcggtcgaactgataataatatcggcatcctgcaaacgggcgtcgatatcgctgagcgagataacctcagcgcctacctcatccgccagggcttgcgcgcgctcgcgggttcggttggcgataatcatcttttgtactttatgctcgcgcaggtgacgcgccaccagttcaatggtttcgcccgcgccaactaacagtacggtgaccgtcgagagcgattcaaagatttggcgggcgagcgtacaggcggcaaacgcgacggagacggcgctagcgccgatatcggtttcagtccgcactcgcttagcgacggaaaaagacttctgaaacattcgctccagcgcgctggcgttaaggtggcctttttgcgaatccgcaaacgcttttttcacctgaccgaggatttgcggttcgcccagcaccagtgaatccagaccgctggcgacgcgcatcaggtggctgacggcgtcattgtcctgatgccagtacagactgttgcgcagatcgtcctcgttcaggttatggtaatcgcataaccagcggatcagcgcttcttgcaggttatcctgctcttccacgctcagatacagctctgtacggttacaggttgacagcacgaccccgccctgcaccattggctgcgcaagcaggctgtccagcgcctgatcaagcgtgtccggcgaaaacgttacgcgttctcgcagcgatacaggtgccgttttatggttaataccgagcgctaaaagggtcatgtctgcgggagtagtaccagcgttgatatggttagtctgcttgcatcatacaggatgcgcgtggtcaataaaagagagagcccccttttggagtaattggcagcgctcgctaatttgatgatttaagacaacttgaaagtagacgatgtcaccaggcggcgctagcattaaaggctataactgtaaccgatagcaaaaatttgccgaatcgcggcgcgaacgtttttacagcctgcaggttcagttttcaggcctgataagcgtaacgccatcaggcaattattgcaccgtatcacaaggattcgtcatcactatgaccctgcccgattttcgcctgattcgtctactgccgttagcaagcctggttctcaccgcctgtacgcttcctgggcataaaggcccgggcaagagcccggattcccctcagtggcgccagcatcagcaagaggtgcgtcatctgaatcaataccagacgcgcggcgcctttgcttacatctcagatgatcagaaagtctatgcgcgtttcttctggcaacagaccggacaggatcgctatcgcctgctgctcaccaatccgctgggcagcaccgagctggagcttaacgcccagccgggcaacgttcagttggtggataacaaaggccagcgttataccgccgatgacgccgaagagatgatcggcaaactcaccgggatgccgattccgttaaacagcctgcggcagtggatcctcggtctgcctggcgatgccaccgactacaaactggacgaccagtatcgcctgagcgaagtgaactatcgccaggatggtaaaaactggaaagtggtttacggtggctatgacagcaaaacgcagcctgccatgcctgccaatatggagctttcagacggcagtcagcgcattaagctgaaaatggataactggattgtgaaatgatgacccattggccttctccggcaaaattaaatctgtttttatatatcaccggacagcgagcagacggctaccacacgctgcagacgctgtttcagtttctggattatggcgacacactccacatcgaaccgcgtcacgatggcgaaatccatttattaacgccggttaacggcgttgaaaatgaagacaatctgatcgtccgtgccgcgcggctgttgatgaaagtcgcctcggagagtgggcgcctgcccgccggaagcggtgcggatatcagcattgagaagcgccttcccatgggcggcggtctgggcggcggctcatctaacgccgcgaccgttctggtggcgctcaatcatctttggcaatgcgggctttccattgatgaactggcgacgctcggcctgacgctcggcgccgacgtcccggtctttgttcgtggccacgccgcgtttgccgaaggcgtaggcgaaatattaacgccggtgaatccgccggaaaaatggtatctggtcgcgcaccctggcgtaagcattcccacaccggttatctttaaagatcctcaattgccgcgtaatacgccaaaaaggtcaatagatacgttactaaaatgtgaattcagcaatgattgcgaggttatcgcaagaaaacgttttcgcgaggttgatgcggcgctttcctggctgttagaatacgcgccgtcgcgcctgactgggacaggggcctgtgtctttgctgaattcgatacagagtcttgtgctcgccaggtgcttgagcaagccccggaatggctcaatgcttttgtggcgaagggtgtcaacctctccccattgcatcgagagttactctaacgcattcgggtttcaggaagatggcgaaatgacgagtcgccggtcatatatgccgtatttgaccggtgtgaggcatcgataccagcgcacatgaaacgtgaatgaagacgagtaagccgggcaagctgagcttcggtgacaacgtcaccttgttccagacgttgcatcgcgctctttaatacaccgcctggataggattttgcctggcccgcacagttttcggcagattctttccaccaatggacgcatgcctgaggttcttctcgtgcctgatatgaagctttttgctggtaacgctaccccggaactagcacaacgtattgccaaccgcctgtacacttctctcggcgacgccgccgtaggtcgctttagcgacggcgaagtcagcgtacaaatcaacgaaaatgtacgcggtggtgatattttcatcatccagtccacttgtgccccaaccaacgacaacctgatggaattggtcgttatggttgatgccctgcgtcgtgcttccgcaggtcgtatcaccgccgttatcccctactttggctatgcacgtcaggaccgtcgcgtacgttccgcccgtgtgccgattaccgcaaaagttgtcgctgacttcctgtccagcgtcggcgttgaccgcgttctcaccgtagatctgcatgctgaacagatccagggcttctttgacgttccggttgataacgtgttcggtagcccaatcctgctcgaagatatgctgcaactgaatctggataacccgatcgtggtttccccggatattggcggcgtggttcgtgcccgcgctatcgctaagctgctgaacgataccgatatggctatcattgataaacgtcgtccgcgcgcgaacgtttctcaggtgatgcacatcatcggcgacgtcgctggccgtgactgcgtgctggttgatgatatgatcgataccggcggtactctgtgcaaagcagcagaagcattgaaagaacgtggcgctaaacgcgtgtttgcctacgcgacgcacccgatcttctcaggcaatgcggcaaacaacctgcgcaactccgtcattgatgaagtcgttgtctgcgacaccattccgctgaccgacgaaatcaaagcgctgccgaacgtgcgtaccttgaccctgtcaggtatgctggccgaagcgattcgccgtatcagcaacgaagaatcgatttccgccatgttcgagcattgatcgaacccggatctgaaacccgctgcggcgggtttttttgtctgtaacacccttttgtatgacttatgcctccttcacctgccatttagttgacagatgatgcgctcatggatgaaacattattgtgaacaaattattttcctcacatgtgatgcctttccgcgctctcatcgatgcttgctggaaagaaaaatataccgcctcccggttcacccgtgatgtgatagccgggatcaccgtcgggattattgctatcccgctggcgatggcgctggcaattggcagtggcgttgcgccgcagtatggcctctatacctccgctgtcgccgggatcgtgatcgcgctaaccggcggctcgcgctttagcgtttccggccctaccgccgcgtttgtggtgattttgtatccggtatcgcaacagtttggtctggcgggcctactggtcgccacgctgatgtcgggcttcttcctgatccttttcggcctggcgagactggggcgattgattgaatatatcccggtgtcggtcacgttgggttttacctcagggattggtattaccatcggtaccatgcagattaaagattttcttggtctgcagatggcccatgtgccagagcactatttgcagaaagtcggcgcgctgtttatggcgttgcccaccgtcaatattggcgatgccgccattggcgtggtaacgctgggaacgttgattttctggccgcgtctcggtattcgtctgccaggacatcttcccgcgctgctggctggttgcgccgtgatggggatcgttaatctgctgggcggcaatgtggcgactatcggctcacagttccattatgttctggctgacggcactcagggcaacggcatcccgcagctcctgccgcaactgatgctgccgtggagtcttcctggctccgatttcacgctaagctgggattcactgcgcgcgctgctgccagcggccttctcgatggcaatgctgggggcaatcgaatcattgctctgcgccgtcgtgctggacggcatgaccggcaccaaacataaagctaacagcgaacttatcggccaggggctggggaatatggtcgcgccgttctttggcggcatcaccgccaccgccgcgattgcccgctctgccgccaacgtccgcgctggcgcgacctctcccatctcggcggtaattcacgctatcctggtcattctggcgctactggtcttggccccgctactctcctggctgccgctttccgcgatggcggcgctactgctgatggtggcatggaatatgagtgaagcccataaagtggtggatctgttacgccatgcgccgaaagacgacattatcgttatgctgctgtgcatgtcattaacggttctgtttgatatggtcatcgccatcagcgtggggattgtccttgcttccctgctgtttatgcgccgtattgcgcgtatgactagacttgcgccggtcaatgtcgatgtgcctgatgatgtgctggtgctgcgtgttatcggtccgctctttttcgccgcggcggaagggctgtttaccgaccttgagtcacgtattaagggcaaacgtatcgtcgttctgaaatgggacgcagtaccagtgctggatgcaggcgggcttgatgcttttcagcgttttgtgaagcgtctgccggaaggttgcgaattgcgtatcagtaacctggagttccaaccgctgcgcacaatggcgcgtgccggtatcaaacctattcctgggcgtctgaccttcttcccgaacaggacggaggcgttagcggatttactcagttaatggacaatgcccggtggcgataacgcttaccgggcctgaaccggttagctatgacgacgattgtcgttacggcggcaacgtttgtcatagtgacgtacccaccaatatttgtcgctcacctgctcatgcccccctacacgagcccccgccagccaaagaactgcaccgacaaaaatgctcagtattgcgccatgcgcaaaaaattgcggcaaattaaactgcggcagttggtttaaaatagagtaacccacgccgacaaccatcacgaccagccccaaccccatcagcacgttaccgaataacgaagcgtttttgcgtttcatatgtcacctccggaacttttgggttgtttttaggaaatccccctaaactttatgtgtaaagtatagacaacactttcgtttgtaagtgcgggtgcgatcacaaatgtaaagtttcatttaacaaaactttacaaataacacactgaacagtttacatttttaataatcaatgctggcaattatttaatttacttcagagtgtcgctgtgttttgtcaagcgggcagacagacagtaaactacgcgccagttatggatctactcaggacaaaaaacgtggcaattaaattgattgttggtctggcgaatcccggtgcggaatatgccgcgacgcgacacaatgcaggcgcatggtacgtcgatttactggcggagcgcctgcgcgcgccgttgcgtgaagagcctaaattctttggctatacctcacgcatcacgctggaaggggaagatgttcgcctgctggtacccaccacgttcatgaacctcagtggtaaagcagttggcgcaatggccagtttttaccgtattcagccggacgaaattttggtcgctcacgacgagctggatctccctccgggcgtcgcgaaatttaaacttggcggcggccacggcggccacaatggtctgaaagacatcatcagcaagctgggcaataatcccaactttcaccgattacgcgttggaattggtcatccaggcgataaaaataaagttgttggtttcgtgctgggtaaaccccctgtttctgaacaaaaattaattgatgaggccattgacgaagcggcacgctgtacggaattgtggttcaaagagggtctggccaaagcaacaagccgtttgcatacctttaaggcgcaataaccagtgatgtgcggcatttttgccgcacgccgtgtataataggcgaagttatttccatttctgcaatctgttttctataacaggttgattattaagatattaaggtgagttaaatcatgggattcaaatgcggtatcgtcggtctgcccaacgtcgggaaatccaccctgttcaacgcgctgacaaaagccggtattgaagcggcaaactttccgttctgcactatcgaaccgaataccggtgtcgtgccgatgcccgatccgcgtctggaccagttggctgagattgttaaaccgcaacgcattctaccaaccacgatggagttcgtggatatcgccggtctggtaaaaggcgcgtccaaaggcgaagggttgggtaaccagttcctgaccaatatccgtgaaactgaagctatcggtcacgtggttcgctgctttgagaacgacaatatcatccatgtggcgggtaaagtaaacccggcagaagatattgatgttatcaataccgaactggcgctggctgacctcgatacctgcgagcgcgctatccatcgcgtacagaagaaagccaaaggcggcgataaagacgccaaagcggaactggccgcgctggaaaaatgcctgccgcacctggccgaagcggggatgctgcgttcgctggacctgacggacgaagataaagcggctatccgttatttaagcttcctgacgctgaagccgacaatgtatatcgctaacgtcaatgaagacggttttgaaaataacccgtatctggaccaggttcgcgaaatcgccgccaaagaaggttcggtcgtggttccggtgtgtgccgccgtcgaagctgatattgctgagctggatgatgacgagcgcgacgaatttatggctgaactgggtctggaagagccggggctgaaccgcgttattcgcgctggttatcgcctgctgaacctccagacctacttcaccgccggggtgaaagaggttcgcgcatggactattccggttggcgcaaccgcgccgcaggcagcaggtaaaatccataccgacttcgaaaaaggctttatccgcgcccaaactatcgcttttgacgactttattacctataaaggtgaacaaggcgcgaaagaagccggtaagatgcgagcggaaggcaaagattatatcgttaaagatggcgatataatgaacttcctgttcaacgtctaaataaaatttgttgtctcgtgaggttttgctgaatctcataagaggcaaagaaagtcataaaatccacgcagccgcgtggattttttatttcataatatctcaactcatactgacaggctcaattaacgcagagctaacagggtaagttcttttcttaattaccagtcgacattcactgtatggttataaaaaggatgctgatcctttagcggcgtctcataacttgggatcgcatcataatcatcttttccccgaacggaataccttcccgcttcgatatcaaaacgatgtttgagccatcccgcaacatgacttgcgaaagcctcttttcttcttaatggccaatcgacagaagccaaattaacatctaataagtaccgcccttctttattaaccttgatcattccagcctgcagtaacgcccgtaccacctgggattggttatcatgaatccagacccaggcatttccaaattccattgcataactatcatttaaaaaatctttttttgaatataattcacttacataatcattgatagagtcagcataattttttactttagatgcagataaatcaaaaaaagattcaaattcgaaagtattgtcattaatacaggacagtaacgcacccggttccgagagctgggtccatgattgtaaactctctacagctataatgaatttgaaagtatttcttccaatgacaccccggtcaattaaagttaaaatatcgtgagctacggtagggatatcttctgcaaacgggacgattatccccgcaccacttatttcgcttgatctaaaatcaaatcctggggtactttcaatgttttccggaataccatactctttaatatgattaaggaaattattaatatcgccacgatatggccatcgccattcacgttcatgtgtccagtcaatcttacctggaacataagtaacatatctatattgttcaatcaaaggaagagccgtttcatcaagaatacgttccccgtttctgccttgcgagcatcgagcattgttatgctgatccaacccatatatgactggccttgccccataattaaacatttgctctttaggtaaaacgattgcatataaaccgattttttcatttcgttctaatcggcgaacaccagtctctaaataagctgcaatcggcatatctgtaaagcataccaccggggagtcaccatatacggttcgttgcccatttcggtatgaccaggacgagaaaattttatgactgcgtaaagataatcgaagtaaatatttagcatcaatgaaacatgcgtggtgctgattattaaaaccacagtgctcaggcaaataaatatggctaccggtctctaaattaacgtcccgaaaaaaatgaatcaaataatcggataagtcaaatctgatgttatttttcatgggacgccctctttcaaacagtctcttttttgcattcctttaaaaccagcatcactattttatataaaaatcatcacgaagtatgcttcttttaacgatgacctcaaatcctccccccttttgcatcaacttacgcatccctgaaatggcgagaacaggctaaatctacccgaggtcactcgctaaaaacctcatcctggaacaagctcaaccgcccttccccgctacggccctttcgccgaaaaaccgataatgggtataaatataccgctataagctatacccacacacttcacattgtttcttatcgttaatccgatacgcttttttcacattatttctggcggtatacgccggtgcaaagtgaatcgggctcgtttccgcgctcgcgcgtaacacaatgatttaccttgctggcggaacgtcaacggacccgcaaaagcgccttatgcccctggcggagcgtggtgcaaaaaggagaaaaaatacgcgttatgaataacgaggagaccttttatcaagccatgcgtcgtaagggagtgacccgacgcagctttctcaaattctgtagccttgccgccacatcgctgggactgggcgccggaatgacgccaaagatcgcctgggcgctggagaataaaccgcgaattccggtggtctggattcatggactggaatgcacctgctgtaccgaatcctttatccgttcctcgcacccgctagccaaagatgtgatcctctcgctgatttcccttgattatgacgacaccctgatggccgccgccggcgcacaggccgaagaagtctttgacgatattaccactcgctacgccgggaaatacattctggcggtggaaggcaatccgccgttaggagagcaaggaatgttctgtatcagcggtggccgcccgtttattgaaaaactgaagaaagccgccgcgggcgccagcgctattatcgcctggggaaactgcgcctcctggggttgcgtccaggccgcccgccccaatccgacccaggcaacgcctatcgataaagtgatcaccgacaagccgatcgtgaaagtccctggatgtccgccaatcccggatgtcatgagcgccattatcacctatatggtgacgtttgatcgtctgccggaactcgatcgcatgggccgtccactgatgttctatggtcagcgtatccacgataaatgctaccgccgcgcccattttgacgccggtgaatttgtcgagagctgggatgatgacgccgcccgcaagggatactgcctgtacaagatgggctgtaaagggccaaccacctataacgcctgctcctccacacgctggaatgacggcgtctcctttcctatccagtccggtcacggatgtctgggatgctcagaaaatggtttctgggatcgcggctcgttttatagccgcgtggtggatattccccagatgggtacccattcaaccgccgatacggtggggctgaccgcgctgggcgtggtcgcggcgggcgttggcggtcacgctgtcgccagcgcgctcaaccaacgtaaacgccacaaacaacagttagcgcaagccgaacaacagccggacaatgaggataaacaggcatgagtaaccagtatcaaacccagggttataccgttaacgacgccggccgtcgtctgatcgtggacccgattacccgcatcgaagggcatatgcgctgcgaagtgaacattgatgagcaaaacgtcattaccaatgccgtttcctgcggcacaatgttccgcgggctggagatcattctgcaaggccgtgacccgcgtgacgcctgggcgtttgttgaacgtatttgtggtgtatgtaccggggtacatgctctggcatcggtgtacgctatcgaagatgcgattggtatccaggtgccggataacgccaatattatacgtaacatcatgctggctacgttgtggtgtcacgatcatctggtccatttttatcagttagccggtatggactggattgatgttctgaatgcgctgaaagccgatccgcgcgccacctcgcagttggcgcaaagcctttccgcctggccgatgtcatcgccgggctacttctttgacgtacaaaatcgattaaagaaatttgtcgatggcggtcagcttgggatattccgtaacggctattggggacatccacagtacaaattgtcgccagaggctaatctgatgggctttgcccactatcttgaagccctcgacttccagcgcgagatcgtcaaaatccataccatatttggcggtaagaacccccatcctaactggatcgttggcgggatgccgtgcgcgatcaatctcgatcaaagcggcgcggtcggggctatcaatatggagcgcctcaacctggtgcagtcgatcatcacccgcaccgccgactttattaacaacgtgatggttccggacgcgctggctatcggccagttcaataaagcatggagtcaaattggcaccggtctgtcggataaatgcgtgctgagctacggcgcatttccggacattgccaacgacttcagccagcaaagcctgttaatgccgggcggcgcggtgatcaatggcgattttaaaaatgttatgccggtagatttggccgatccgcagcagatacaggagtttgtggatcacgcctggtaccgctatccggacgatcggctgggccgtcatccttttgacggcattaccgatccctggtacaacccgggtgatgtcaaaggcagcgatacgcatatccagcagctcaacgagcaggaacgctactcctggattaaagcgccgcgctggcggggtcatgccatggaagtcggcccgcttgcccgaacgcttatcgcgtatcacaaaggggatgccgccaccatagagtcggtagatcgcatgatgtctgcccttaaactgccgctctccggtatccagtctacgcttggccgtattttatgccgcgcgcacgaagcgcaatgggccgtcggtaagctgcagtattttttcgacaggcttatgaccaacctgaaaaacggcgacctggccaccgccaataccgagaaatgggaaccggccagttggccgcagcactgccgcggcatcggttttaccgaagcgcctcgtggagcgttgggacactgggcgtcaatccgcgatcagaagattgaactctatcagtgcgtggtccccaccacctggaacgccagcccgcgcgatcctaaaaaacagatcggcgcctatgaagcggcattgatgggaacgcaaatggcgattcccgaccaaccgttagaaatcctgaggacgctgcacagcttcgacccctgcctcgcctgttcaacccacgtgctcggcgacgacggcagcgaactgattgccgtccaggtacgctaagcgttaaggaaaagaacgatgactggaaagctatctccacgcgtcggggaggcgcgtgatactgccgtcagccactatgtgtttgaagcgccggtacgcctgtggcactggctaacggtggcctgcatgttggtactgatggtaacaggctacttcattggccggcccttgccgtcggtgagtggcgaggcgacctatctgttttacatgggctatatccggctgatccactttgccgccgcgatgatctttaccgtgttactgctggggcgaatttattgggcctgtgtcggcaaccgctattcacgagagctgtttattgtcccggtctggcgtcgtagttggtggcaaggcgctttcaccgtggtccgctggtatctgtttctggagaaaaaaccggggagcgacatcggacataaccctgtcgcgcaggccgcgatgttcggctatttcctgttgtcggtatttatgatcctcaccggtttcgctctgtttggcgagcatagccagtacgccatctttgcgccgttccgctatgtggttgaatttttctactggaccggcggcaactccatcgatattcacagttggcaccgactgggcatgtggctgatcgccgccttcatcgtcgggcacgtttacctcgctatccgggaagacattatgtccgacgatacggtgatctccaccatgatcaatggctatcgcagccataaattccccaaaccgcacgacaaggagccctcatgaatgcgcaacgcgtagtggtgatggggttaggaaacctgctgtgggccgatgaaggattcggtatccgggtcgcggagcgtttgtatgcccgatatcactggcctgaagaggtagaaattgtggacggcggtacgcaagggctaaacctgttaggttatgttgagcaagccagccatctcctgctccttgacgcgatcgattacggcctggcgccgggcagcctgcgaacctatgccggcgagaaaatccccgcgtatctcagcgccaaaaaaatgagcctgcatcaaaacagtttttccgaagttctggcgctggccgacatccgcgggcatctgccctgtcacattgcgctggtcggcctgcaaccggcgctactggacgactacggcggtagcctgagcgaaatagctcgcagccagctaccggcggcagaacaggccgccctggcgcaactggccgcctgggggatcgtgccgcaggcaaatgaggtcgcacgctgcctgaactataaatgcctgtcgatggaaaattatgagggagtgcgcatacgtcagtatcagacacgtctggagggcaaaagaagtggcgaatgacaccccgttctctgcgctatggcaacgcctgttaacccgtggatggcaaccggtagaggcttctacggtagacgactggatcaaacgggttggagatggcgtcatcctgttaagtagcgatccgcggcgtacgccggaagtcagcgataacccggtgatgattgccgaactcctgcgtgagttcccgcagtttgactggcaggtggcggtggccgaccttgaacaaagcgaagctatcggcgatcgctttaatgtacgtcggtttccggcgacgttggtttttacagacggcaagctacgcggcgcgctcagcggcattcatccctgggctgaactgctcacgctgatgcgttcgatagttgacactcccgcagcgcaggagacagtacaatgagcaacgccttttttcatctgctggggccaggtacgcagcctgatgacgccagtttctcgatgaatcccttaccgctcacctgtcaggtcaatggcgacccaagtatggcggcgctggagcgctgcgctcacagcccggcggtgatggcattgttgaccgatctgcgaggtcagcttgcccggcgcatcccggaagtcggcgacgtgctgggatgggagttatctcccctgaatgccgatgatctctcattcctcaatacgctattgggcgaaggcgaagtctcggtacgcattcagcatccggacgggagtgaaagcgagatccaggagaccatcttctgcggcctgtggcgggtacgccatctgcataaccgacgtctgctgacggatcgtctggaagcgggtagcgcgcccctgacattatggcaagcggcgactgccgatacgctgcctgacgactctctgctgcctccgcctgtcgctggcctgatgaatggactgccgctggcccatgaattattggcgcacgtacgcgatccggcgttgcaaccacacagcatcaatttgacccaactgccgctcagcgaggccgatcgtctttttctggcgcgtttatgcggacacgggaacatccagattcgcatctccgggtatggcgaaagccaaatcaacgccacagcattgcgccatctctggcatgtgcgctgtctggacgcccttaaagggccgttgctcgatagctatgagatttgtcctttgccggagctggtactggcggccccggaagatctggccgattcgcgccagcgcctggatgaagtctgccgatggctggagacgcgctagcgctctcaacaggaacgtcaccggagtccggtactgattagctttttactctctttctgcctacaggagttagcatgtgggatgtcattgacttatcgcgctggcagtttgcgctgaccgcgctgtatcactttttatttgttcctcttacgcttgggctgatttttttgctggccgtcatggagacgatctatgtggtgacggggaaaaccgtctaccgcgatatgacgcgtttctggggcaagctcttcgggatcaattttgctctcggtgtggctaccggcctgaccatggagtttcagttcgggactaactggtcgctctattccaactatgtgggcgatatcttcggcgcgccgctggcgatggaagcgttactggccttttttctcgaatccacttttgtcggtctgttctttttcggctggcagcggctgaataaataccaacacctgctggtcacctggctggtggccttcggctccaatatttcagcattatggattctgaatgccaatggctggatgcagtatcctaccggcgctcatttcaacatcgatacgttacggatggaaatgagcagcttcagcgatctggtctttaacccggtgagccaggtgaaattcgtccataccgtcatgtccggttatgtcaccggcgccatgtttattatgtccatcagcgcctggtatctgctacgtggccgcgagcgtgaggtggccttgcgctcgtttgctatcggctcagtattcggcaccctggccattctgggaaccctgcaactgggggacagttcggcctacgaagtcgcccaaattcagccggtgaaactggcggcgatggaaggcgaatggcaaaccgaacccgcgcccgcgccgtttcatctgattgcctggccgcagcaggaacaggagcgtaatgcatttgccgtgaagatccctgctctgctgggtattctggccacccattcgctggatacaccggttccggggttaaaaaacctgatggacgacgctctgccgcgcctgaagcgtggccgggaggcctggttactcatgaaggagatagcgcaaggcaatcgctcgccgcaggtactgaatgcgtttcacgccgttgagggcgatctggggtacggcattctgctggcgaaatatgccccggatatgaaccatgtgacgccggagcagtatcgtgcggcccagcgtggcgctattcctcaggtggcgccggtgttctggagtttccgtattatggtcggctgcggttcgctgctgttagtggtgatgttgattgcgttgatacagacgctgcgaatgcgtatcgaccagcatcgctgggtattgcgtatgacgctgtggagcctgccgttaccgtggattgccattgaagccggttggtttatgacggagtttggccgtcagccctgggcgattcaggacattctgccgacctggtacgctcactccgcgctgacgccgggccagctggccttctcaatgggacttatcctcggactttacaccctgtttttaatcgcggaagtctatctgatgcagaagtacgcgcgtcttgggccgagcgccatgcaacatcaacaacaagcgcaacaacagggataaaggagacaatcatgttggattatgaaacgttgcggttcatttggtggctgctgatcggcgtcatcctggtggcatttatggtaactgacgggtttgatatgggtgtcggttgcctgctcccgctgatagcgcgcaacgatgacgaacgccgggtattgatcaatagcgtgggcgcccactgggaaggaaaccaggtatggttgattctcgcgggcggggcattattcgccgcctggccacgggtctatgccgccgcgttttccggtttttatgtggcgatgatcctggtgctgtgtgccctcttctttcgcccgctggcctttgattatcggggaaaaatcgccaatgcccgctggcgcgcgctgtgggataccggtctggttatcggcagcctggttcccccagtcgtattcggcatcgcgttcggcaacctgtttttaggcgtgccgtttgccttcacgccgcagcttcatgttgactattttggcaccttctggcagttactctcgccctttgccctactgtgtggattattgagtctgtcgttggtgattatgcaaggaggcgtctggttacagttgaaaacggagggcgttattcgtcaacgggctctgtcggccacccgctacagcgcgctgctgatcgtgatctgcttcctgctggccggttactggctgtgggccggcgttgatggctttgtcttgctcacgcaggatgccaacggcccttccaatccgctcttaaaaggcgtggcgatactccctggcgcatggatgaaccactttatacgctcgccgctactgctcatcatcccgttgctcggtatgatcctgccgattctggctttctatgcctgccttcgcggtcagactattcgtggatttctgttcgcttccctgacccaggcctgcgtcatctttaccgccggcataacgctatttccttttgtgatgccgtcgagtgttagtcctctctccagcctgacggtgtgggacagcacctccagccagatgacgctcgaaatcatgctggtgattgtgctgatttttctgccgatcgtactgctctatacgctatggagctattacaaaatgttggggcgtatcaacctggggaccctccgccgcaacgatcatgaactttattagggagcgggagcgatgtggtatttactgtggtttgtcggcattctgctgatgtgctcactgtcgacactggcgctggtatggcttgagtcgcgtcaacaataaagaggtaaaccggggtcagcgccgtctgactccggttatttttatctttttacgcgcctggtgaagacgtttccccgccgacaggacgacataacattgatacatgtcgttatcataacgtttacttttagaggtgcgtcataattatgacaaatagccaccttgcacatatttcgcatatttaagcaattaattgcataattagcaatatatcacctcttatagcggatagttaaccacttcccatccaaaatcataacgaaaatccaactgcctgccatttttgatctgagttaattgtttaaaaaagtgttaaatttatcgctacatggtgtgatctactatgtaccacggtcaattaaagaacatattacttttatcactaaggtttatcatggataagttatcttacgcttcagatagcagcacatctgcctggaatacctacctgcaacaaatcgagcgtgtggccccttatctgggcgagttatccccctgggtggatactctgcgccacccaaaacgcgctctgatcgtcgatattccggtacaaatggatgatggcactattcgtcatttcgaaggatatcgcgtgcagcacaacctctcccgaggtccgggtaaaggcggtgttcgctaccatcctgacgttgatctcaatgaagtgatggccctgtcagcatggatgaccatcaaatgtgccgcgctgaacctgccatacggcggcgctaaaggcggtatccgcgtcgatccgttctcgctgtcggaaggtgaactggagcgtttgacccgccgctataccagcgagatcggcattatcatcgggccgcagaaagatattcctgcgccggatgtcggcaccaacggtaaagtgatggcctggatgatggatacgtattccatgaatcatggcacgacggtcactggcgtcgtcaccggtaagcctatccatcttggcggttcgctgggccgtgaaaaagcgacggggcgcggcgttttcgtcagcgggctggaagccgcacgtcgggcgaatattgctgttgaaggcgctcgcgttgcggttcagggttttggtaacgtcggcagcgaagccgcgcgtctgtttgcaggcgctggcgcccgtgtcgtggcgattcaggatcataccgcgaccctgtttaacgccaccggtattgacatgaaggcgctcacggcatggcagacagaacacaaacagatagccggtttcccgggcgcggaaactatcgccagcgatgcgttctggcgtctggagatggatattctgatcccggcggcgcttgaaggtcagataactcgtcagcgcgcggaagccctgacgtgtaagctggtgctggaaggggctaacggcccaacctatccggatgctgatgatgttctggccagccgtggtatccttgtggtgcctgacgtggtctgtaacgcaggcggcgtaaccgtcagctacttcgaatgggtacaagatatggccagcttcttctggagcgaagaagagatcaatgcgcgcatggacaaaatcatgaccgacgcgattgtccatgtctgggagaaagcggctgagaaatcctgctctctgcgcaccgcagcctatattgtcgcctgtgagcgcattctgctggcccgtaaagatcgcggtatctatccaggttaaggcgacaaatcattgcgctaaaatccacgtcccggcgtggattttttgtctgtataccccgttttccacgcgcgcgccgataaattctgtctcaataaaatgtctgtttgttcgcaaaatagcggttcaatcacgcgtatctggtcatcgtagactaaggttttgtcatggtaaatgccgttggctttggctcaccgctaaggagataacttgatgatacccccagagattcgccgttctgttctactgcagaaagccataaaactggcgctggcagggacgctgctgacgtttgcatcgttttcggcgactgccgcagacccgtcttccgacactgaaactccgcagccgccggatattttgcttggcccgctctttaatgatgtccagaatgcaaaactcttccccgatcagaaaacctttgctgacgccatacctaatagcgatccgctcatgattcttgcggattatcgtatgcagcggaaccagtccggcttcgatttacgtcattttgttgatgttaacttcaccctgccgaaagcgggtgaaaaatatgtcccgcctgccgggcagtcattgcgtgaacatattgatggcctgtggccggtgctgacacgttcaactaaaaacgtcgaaaagtgggactcgctcttgccgttgcctgaatcctatgtcgtgccgggtggtcgattcagagagatttactactgggacagctactttacgatgctggggctggcggaaagcgggcactgggataaggtggcggatatggtggcgaactttggttacgaaattgacgcctgggggcatattcctaacggcaaccgtacctactacctgagtcgttcgcagccgcctttctttgcgtttatggttgagttactggcgcaacatgaaggtgacgatgcgctgaaagaatacctgccgcaactgcaaaaagagtacgcctactggatggagggcgttgagacattgcagccagggcaacaaaaccaacgcgtcgtcaaactggaagacggcagcgttctcaaccgctactgggacgatcgggatacgccccgccctgaatcctgggttgaagatatcgctaccgccaaaagcaaccccaaccgcccggcaacggagatctatcgagacctccgttctgctgccgcctccggctgggatttcagctcccgctggatggataatccgcagcagctcagtaccattcgtaccaccactattgcccctgtcgatcttaacgctctgctgtatcaactggagaaaaccctcgcccgcgccagcgctgcggcgggcgatcgggccaaagcctcgcactatgacgcgctggccaacgcgcggcaaaaagccattgaaatgcatctgtggaataacaaagagggttggtatgccgactacgatctgaagaacaataaaatccgtgaccaactcaccgctgccgcgctgttcccgctctatgtaaacgccgccgcgaaagatcgcgccgcgaaagtggcggcggcggcccaggcgcatctgctacagcctggcgggctggctaccacctcggttaaaagcggacagcaatgggatgcgccaaacggctgggcgccgttacaatgggtcgctgccgaaggattgcaaaattatgggcaggatgacgtggcaatggaagtcacctggcgctttttaaccaatgtgcagcacacctacgatcgcgagaaaaaactggtcgaaaaaaatgatgtcagcagcaccggaaccggcggtggcggcggcgaatatccacttcaggacggctttggctggaccaacggcgtgacgctgaaaatgctcgatctgatttgtccgcaggaaaaaccgtgcgatagcgtaccgtctactcgtccggcatcgttaagcgcaacgccgacaaaaacgccgtctgcagcgacgcagtaacgcgtgtttatagtaggttgacccggtgctgaccgggtcaacgcttacacgttctgcagcggttagccgcgtcgcagaaggcggaaaatcaccagcaccacgatcgcgcccaccacggcgaccaggaaactgtgcagattaaagccgctgatactgccgccaataccaaacatcgtcgccagccatccgccaacgaccgccccgacgataccgagaatacaggtcaggataaatcccccgccatcgcgccccggcataagcaatttggcgataacgccggcaatcaaaccaaaaacaatccaggcgataattcccatttgcgaaccctctttccagtaaaaacgttttaagtataggcaaagtcgagcgtcgcatttctgaacactgatttatctcgcggacataaaaatttatttatcgctattaagttctttctaccgatgccgataacccaacgatagtctgcgtatcaggggttatttcgtgtgagtggttacaatgagcagttcctgaaaaaaaatccattagcgatattaggcgtgctacgggatttaaataaaaatcaggttccactgcgtatttcatgggcgcatggtcaattcatcagtaaaattttggcggtagacccggaaaaactcatcgtggattacggcagccaggaatacgaaaatagcgccgtattacgtgccgggcaggtagccattatcgcagaaacgcagggcgcaaaagtcgagttcacgttgccgcaactcgttacaggcgaatatcagcggctgccggcctttatcacgcccctgccgtcgtcactgtggtttgtccagcgccgggagtattttcgcattggcgcgccgctgtatccgccttattacggcgtcaccacgctaccggacacccgtacgttacgttttcgcctgtttgatctttccctgggcggcatgggcgcgctactggaatccgccatccccgacggactaatcgaaggcgcacgcttttcgcaggttgaactgaacatggggcaatgggggatttttcacgttgacgcccagcttatctccatcagcgagcgtaaggtgattgatgggaaaaatgaaacgatcaccactccccgcctgagctttcgtttccttaacgttagcccggcggtggagcgggagttgcagcggattattttttcgcttgagcgcgaggcccgagaaagagcgaataaagtgcgagaataatcttcacgctaaactacatggcgtccagcgcctgctgaagcttccagatatagcgcggcgcctgcggcgcgggatgattatcaacaacatgttcaaaaaactcgtccgcatccagatcgttaattttttctatcgccttcttcctgtcggatgaaaaagtacgcaataacgcgcctgcgccgttagcataagagacgaccagcgcatattgcatcacctgcggatctttgatgccggccagcggcccattttccagaatgctcagatacgccgcgcccattgagatgttacgctcagggtttttcagctcgctggtggtcggttcgccacgccagcccatacgacggtaaacgtcgcgcccggaggtcgacgcctttaactgcatcaggccaatcgcattagatttactgaccgcgttagggttgccgccggattcaatggcgataatcgcggtgattaaatgcggatcaaccccccatgccgccccggctttttcactgatgggcatccactgcatcgcacgctttacaggcacttcggcattccacggcggattcctgtaatcctgttttgagctacagccagccagtattactaccaaaaaagcaaaccatcttaatttcacgtcatctatccttatagccgtaacttatctgccgaagaggtcataccgccccggccaggcacttaggttgcctccctggtgcgcatccagaaacgtcgcacaacgagggacatcgcctaatatatgcggcatgatatacatttgcattctattgtcagcaaggaattaccatgtctctgtttcatttaatcgccccgtcgggctactgtattaaccaacaggccgcgttacgcggcgttcagcgcctgactgacgcgggtcatcaggtggagaatgacgaggtgattcgtcgccgctttcagcgttttgccggtacggacgcggaacggctggccgatgttaattcgctggcctcgctaacgtcgccggatacaatcgtcatgccggttcgcggcggctatggcgccagccgcttgttggatcgtatcgactggcaggcgctcgcctcccggcaacagcgcgatcccttactgatttgcggtcatagcgattttacggcgattcaggctggactcctggcgcaggccaatgtcatcacctttagcggtcctatgctggcggcaaattttggcgccgaaacgctgaatacgttcaccgagcaacatttctggctggcgctacgcaaggcgcaatttaccgtagagtggcaaggcgacggccctcagtgcgacgcacagggcaccttatggggcggaaatctggcgatgttgatttcccttatcggtacgccctggatgccgactatcgataaaggaattttagtgctggaagatgtcaatgagcatcctttccgggtggagcgtatgcttttgcaactggagtacgccggaattttaaaccgccagagcgccatcgttctcggcagctttagcggcgcggcgcccaacgagtatgacgccggttattctctggagagcgtctacgcgtttttacgttcccgtctgtccgttccgctgattaccggtctcgacttcgggcatgaacaacgtacggtaacgctccctatcggggcaaacgcgatgcttaaaaatacgcgccaggggactcaactcactttatctggccatcctacgctgcaattgtaaaaaaagtccccgacaggctaagtaaaacgctgccctggccgttattatgttaatgttaaataatacgaagtcgtgtgagtcaggagatataaaacgttggatgctgcaacaattattagtctatttattttaggttccatccttgtaaccagcagtatcctgttaagttcattctcatcgcgactgggtatcccgattctggtcattttcctcgccatcgggatgttagcgggtgtggatggcattggcggtattcctttcgataattatcctttcgcttatatggtcagtaacctggcgctggcgattattttactcgatggcggaatgcgcacccaggccagctctttccgggtagcgctgggccccgcgctgtcgctggcgacgctcggcgtactgatcacgtcggggttaacaggtatgatggccgcctggctgtttcatctggatcttatcgaaggtctgcttatcggcgcgatagtcggttccactgacgccgcagcggtcttttctctgcttggcggcaaagggctaaacgaacgtgtaggctccacgctggagatcgaatcgggaagtaacgacccgatggccgtttttctgaccattacattaattgagatgatccagaagcatgaaaccggcctggactggatgtttgccgtccatattatccaacagttcggtctcggtattgtttttggcctgggcggcggttacctgctacagcagatgatcaaccgtatttctctgcccagcggcctgtatccgatgctggcgctcagcggcggtattctgatttttgctttgacgaccgcgcttgaaggcagcggcattctcgcggtctatctgtgcggattcctgttaggaaaccgcccgattcgcaaccgttacggcatcctgcaaaactttgacggactagcctggctggcgcagatcgcgatgttcctggttctggggctgctggtgacgccttccgatctgtggccgattgccgtccctgcgcttattctctccatctggatgattttcttcgcccgcccactgtcggtgtttaccggcctgctgccatttcgcggcttcaatcttcgggagcgcattttcatcagttgggtcggactgcgcggtgcggtgccgattattctcgccgttttcccgatgatggccgggcttgaaaacgctcgcctgttctttaatgtcgctttctttgtggtactggtgtcgctgctcctgcagggaacatcgctgtcatgggcggcgaagagagccaaagtggtcgtgcctccggttggctggccagtatcgcgcgtggggcttgacatccatcctgataatccgtgggagcaattcatttatcagttgagcgccgacaaatggtgcgtcggcgcggcgttgcgcgacctgcatatgccgaacgaaacccgcattgccgcgctatttcgcaataatgaactgtttcaccccacgggtagcactcgcctgcaggaaggcgacgtactctgcgtgattggccgggagcgcgatctgccagcgctgggcaaattgtttagccagtcgccgccggtttcgttagatcagcgtttctttggcgattttatcctcgaagcgaatgcgaaattcgccgacgtggcgcttatctacggtctggaagaaggaacggaataccgggataaacaacaaactctgggtgaaatcatacagcagctgctgggcgctgcgccggtcgtcggcgatcaggtggagtttggcggcatgatttggacggtagctgaaaaagaagataacgtggtacgcaagattggggtacgcgtcgccgaagacgaagcagaataaggtcgcctggcaacgtcgacccgcccccaagtggaccggtcgacgccttagcctgaattaggttacgttgtcacaaacggcacacgcggcgctacggcgcacagtagctcatagcccagcgtgcctgccgcagaagcgacatcatcgaccttaatttctttgccccataattcaaccggcgtgccgattcccgcctgcggacacggcgtcaaatccaccgccagcatatccattgaaacggtgcctactgttctggtacggataccgtccaccagcacaggcgtcccggtcggcgcatggcgtggatagccatcggcataacccgccgcgacgatgccaatgcgttgttcctgagtcacagaataccctccgccatagcctaccctttcacccgcgctcagcgtctgcacgccaataatttcgctactcagcgtcatcacaggttttagtccggtatcggcaatatcccgccactgtcctgacggcgacgcgccgtacaaaataatgcccggcctgacccagtcataatgcgcctggggatgccacagcgtcgctgccgaatttgataacgagtatgcacactgaagaccttccgtcgccagcgcaatacgcctcatcgcctccccgataccttccggatgatcggcctgagcaaaatgtgacatcagggtcatttcaccgacattgcgcattgcccgcaattgctgccagacggtctgcgcccgctcaggctgaaaaccgagtcggttcatgccgctgttgactttgacatagatatccagcggcgcgttaagccgcgcattttgcagcgctttcaactgccagttactgtggatgcaggtggtcagccgataagtgtcatacgcctccaggtcttgcgcatggaaaaacccctccagcatcaatatcggccctttccacccgcgctcacgcagggtaatcgcctcttcaaggttgagcatagcgaaaccatctgtggcgcccagcgcgctccagacgcgttcaataccgtggccgtaggcgttggctttcactaccgaccagacgcgcgcctctggggccgcccggcgcacaatagccaaattttgtttcattacctgtaaatcaaggctggcctgtatagggcgggtcatttcacttcctttatcagttatgcgcgctatgcaaacgttgcgggggggtgggcgtaaaatcggaacggtatcgcgccacgctcagatcgtcgtagggtatcgctggcgtgcgacccgacaagatatcgcttaacaactggcctgaaccgcaggccatcgtccagcctaaggtgccgtgtccagtattaagccacagatttttataacgggtgcgtcctactaccggcgtgccgtccggcgtcatggggcgcaggccggtccagaatgtggcctgctcaatatgaccgccgcgcggaaagagatcgcgcacaaccatctccagcgtctcgcggcgcggttgcagtaagtcggtattaaagcccacgatttccgccattccccccacgcgaatacgcttatcaaaacgcgtaatagcgattttgtaggtttcatcaagaatcgtcgatactggcgcgccgtctggctcgacgattgggatggttaatgaatagcctttcagcggatacaccgggatatcaacaatgcctttaagcatcgccgtcgaatacgatccaaacgccataacatacgcatctgctttaatgatctcatcggcgcatttcacgccgtaaatctgatcattttcgtacagtaatttttccacgggagtattaaagcgaaaggttacgcccgcctgctccgccatgcgcgccagacgctgggtaaagagctgacagtccccggtttcatcattcggtaagcgcagtccgccggttaatttatgcgcaacctcagccagagcgggttcaacttccgccagtcggctggattccaggagctgatacggcaccccggcatcttccagcacggcgatatcacgggtggcgttctcatactgttgcgcggtgcggaagagttgtagcgttcccccctggcggccttcatattcgataccggtcgcggcgcgtagcgttttcagacagtcgcgactatattccgccaggcgcaccatgcggcctttattttccatataatgccgggtatcgcagttacgcagcatttgccacatccacttcagttgaaatggagtgccatccagacgcaccgccagcggcgcatggcgctggaacatccattttatcgccttcagcggtacgccaggggccgcccagggcgccgcatatcccggtgaaatttgtccggcattcgccgcgctggtttcttgcgccgggccggattcgcgatcgatgacggtgacatcatgccccgcctgactcaagtaccaggcgctggtcacgccaactacgccactccccaggatgacaactcgcatagccactccgttaatagtaaaagaacaatcttctgattacatcttgataacccagatgaaaatattattcaacatatgacttttttatggtgacgtgcttcacatataccctaaagacaagcgatcccactggtttgggatctcctgctacgcggcatggctatacagcataaaatgatgccaatacccgattttttgccgttcaatgtggaggaaaccgcaaagaaaagttttcacgatcaagtcgttttttaacatggtgttctatgcttgaaaggaggcgctccatacagagagcgtcgccaacaatgagggtgcgcgaatggcaatgattgattccatgaacaaggacaccacacgtttgagcgatggacccgactggacatttgagctgctggatgtctatctggcagagatagaccgcgtggcgaagctctaccaactggatacttacccgcaccaaattgaagtcatcacttccgaacagatgatggacgcctactccagcgtcgggatgccgatcaactatccgcactggtcgtttggcaaaaagttcattgagacggaacgtctgtataagcatggtcaacaaggactggcttatgaaattgtgatcaactctaatccctgcattgcctacctgatggaagagaacaccatcaccatgcaagcgctggtcatggcgcacgcctgttacggccacaactccttttttaaaaataattatctcttccggagctggacggatgccagctctatcgtcgattacctgattttcgcccgaaattacattacccgctgtgaagaacgctacggagtggatgaagtagaaaaactgctcgactcctgccacgcgctgatgaattacggcgtcgatcgctataagcgcccgcagaaaatctcgttgcaggaagagaaagcgcgacaaaaaagccgggaagagtatctacaaagccaggtgaatatgctgtggcgcacgctgccaaaacgcgaagaagaaaaaacggtcgccgaagcacgccgctttcccgctgaaccgcaggaaaacctgctctattttatggagaaaaacgccccgttgctcgagccgtggcagcgcgaaattctgcgcatcgtgcgtaaagtcagccagtatttttatccgcagaaacagacgcaggtcatgaacgagggctgggcgaccttctggcactacaccatcctgaaccatctgtatgatgaaggcaaagtgacggaacgctttatgctggagtttttacacagccataccaatgtcgtatttcagccgccctataatagcccctggtatagcggaattaacccctatgcgctcggctttgccatgttccaggatatcaaacgtatttgtcagtcccccacggatgaagataaatactggtttccggatattgccggttccgactggctggaaacgctgcacttcgccatgcgcgattttaaagatgaaagctttatcagccagttcctgtcgccaaaagtgatgcgtgatttccgtttcttcacggtacttgatgatgacaggcataattatctggagatctccgccattcataacgaagaaggttatcgggagattcgatcaaaactgtcgtcacagtataacctgagcaatctggagccgaatattcaggtctggaatgtggatttacgcggcgacagatcgctgacgttgcgttatatcccgcataaccgcgcaccgctggataaaggccgcaaagaggtgctgaaacatgtgcatcggttatggggctttgatgtgatgctggagcaacaaaatgaggatggcagcgtagaactgctggagcgttgtccgccgcgcatgaacatgctgtaatcgagatgctgcccggtagtgtttgcgcttaccgggcatcgcgggattatcgtccctgaatcgctaaatcgccgggcagatttttctgcatccgatgccaaatctcgccgctgtcatgcccgtaacgtcgcaccgtttcatacacctggtcgtgcgcgccctgctcgcataacgacgataatttatgatagaaacccagtgccagactgcgcgcttccggattggcgaaatagtggcgaccaatgcgggtgtataaccctttcatgccgttcaggatcaagccgtaaataggattgccggaggcgaatgccagaccacgaaagatgttatagtccagatcggcgaatgcatcggcatggtcggccacttcgtgggcagtggccagtacttcctgcgccttatccgggtgttgacgcaacgcggtacgaataaagatagtagaaatattggtacgcaccgacaacaaattgtcgatcagttgcggaacgctttcatgatcaaggcgggccagcgtttcaaggatattcagccctgacgtttcccaaaaattattaacctttgtcggtttgccatgctgaatggtcagccagccatctcgcgccagccgctgtaacacctcgcgtaatgtcgtgcgcgtcacgccgatcagttcggagagttctcgttctgccggtaagatcgtgccaggaggaaagcggttattccagatactttcaataatatactcttccgcgaaacccgccgggctctgcgccttaatgaccatagtgagatttccattacacagcaaaacatagttgcactcatcataccagacgggcgtaacacctgatagcggacgcaatgaagaaaaaggggatcaaggcaccatttctgatatcgcctgccaatatcgttaaggacttgcttgcattcgtcgcgctcgctactctctgtgtttaaacataaaaacgctatttcatttttctaggtaaggaaaaatttcatggagatctcatggggtcgcgccatgtggcgcaactttttaggccagtcgcccgactggtacaaactggcactacttgtctttttaattgttaacccattcattttcttagctaatccctttattgccggttggctgctggtggcagagtttatcttcactctggcgatggcgttaaagtgttaccccctgctgcccggcgggttactggccattgaagccgttatcatcggtatgaccagcgccgcccatgtacgtgaagaggttgccgccaacctggaagtcttgctgctgctgatgtttatggtggcaggcatctactttatgaagcagttattgctgtttatttttacccgtctgttactcagtatccgctcgaagatggttctgtcgctggccttttgcgtcgccgccgcattcttgtcggctttccttgacgcgcttaccgtcgttgcggtggtgatcagcgtcgccgtcggtttttacgggatttaccatcgtgtggcctcatcgcgcggcgaagagaacgatatgctggacgacagccatatcgatccgcattacaaaacggtgctggagcaattccgcggattcttgcgtagcctgatgatgcatgcaggcgtggggacggcgctgggcggcgtcatgaccatggtcggggagccgcaaaacctgatcatcgctaaagcggctggctggcatttcggcgacttctttttgcggatgtcgcctgtcaccgtcccggtactggtatgtggactgttaacctgtatgctggtcgagaaaatgcgctggtttggctatggcgaaacgttgcccgaaaaagtccgcgacgttttacagcaattcgacgatcaaagccgtaagaagcgcacccgccaggataaaattaaactcatagtccaggcgattattggcgtctggctggttaccgccctcgccctccatctcgcggaggtgggactgattggtctgtcggtcattattctggccaccgcgttaacgggtgtaaccgatgaacacgccatcggcaaagcgtttaccgagtcgctgccgtttactgcgctgttaaccgttttcttctccattgtggcggttattatcgatcaacatcttttcgcgccgattattcagttcgtcttgcaagcctctgaacacgcgcagctaacgctgttctatctctttaacggcctgttgtcttccatctcagataacgtctttgtcggcaccatttatatcaacgaagcgaaggcggcaatggaaaacggcgctatcagcttaaaacagtttgagcttttagccgtggccatcaataccggtactaacctgccatcggtagcgacgccaaatggtcaggcggcattcttattcctgctgacctccgcgctggcgccgttaatccgtctctcctatggccgtatggtctggatggcgttaccgtacactatcgtactgaccctgatagggctactgtgcgtcgaattcactcttgcgccggccaccgaatggatgactcaggcaggatggttagcaacgctttcgtaacgtttggccgggcaatacaccgcccggctccgatttttgcctgataattatccaattacacattatttcatttcccgctagtggcgcacgaattgaattggtttacactgcggtctctacgcatgttgcagggaaattattatgttgcgatttttaaaccagtgctcacggggtcggggcgcatggttactgatggcgtttaccgccctggcgctggaaatggtggcgctgtggttccagcacgtcatgttacttaaaccttgcgtgctatgtatttatgaacgttgcgccctgtttggcgtgatgggcgcgggtctggtcggcgcaatagcgccgaaaacgccgctgcgatacgtggcaatggttatctggatttacagcgcctggcggggtctacaactggcgtatgaacatacgatgattcagttgcatccctcgccgttcatgacctgtgactttatggcgcgctttccagactggttgccgttgggtaaatggctgccacaggtgtttgtggcatccggtgattgcgccgaacgccagtggtcgtttttaacgctggagatgccgcaatggctgttggggatctttgccgcttaccttgtggtggcgatagccgtcgtcatagcccaggcatttaagcctaaaaaacgcgacctgttcggtcgttgatacacacgctccttcgggagcgttttttttgcccgaagcgttgtttgccagtgattaaaaggtgtatattaaatacatcttttaatcaccacatcagggagatgtcttatgtcccacttacgcatcccggcaaactggaaagttaaacgctctaccccctttttcaccaaagagaatgttccggcggcactgctctctcatcacaacacagcggcaggcgttttcggacaactctgcgtgatggaaggcaccgtgacctactatggctttgcgaatgaaaccgcgacagaacccgaagtgaaagtggtgattaatgccgggcaattcgccaccagtccgccgcaatactggcatcgggtagagctgagcgatgatgcgcggttcaacattcatttttgggtagaggaagaccatcagggcgaggaaatgtatcaacagaaaaaagcctgacatcggtaaaccagtcaccactgggcggcgtcccgcccagtagccaggtgattaatggcgctaattaaacgctagagtagtttaattttaacgtggtatccctcaagccctttcatcgtttctcgcggcgcgaactctatttcggaaacctcttgcccggttttcttccgtagttcggcaacctttttgctaatgagtgccgcgatttcctcttctgctttatgtgtcaactcttcgctgttcattgatttcctcctttgaactcgcaaacggctaagcgcaataagacagtgtcgtcatggacgcgctactattttaacgtacaaaaaattataggctatctttctgaggattatcaggatgtttcgctttagaagatgtaaaaaaccgcctggcacagacggtgcatcaggcggttggttaatagcacaagacgctatctacgaggatcttcaacctcattctgggtatccgggtcgagaggatcgtctccctctggtgtatccggaatattttcaccaggaagcggctcatcctctggtaatggatcgactaaatcaggacgttcagacataaagcctccaacgaaccatagttattaaagataccctacagcactacttttggtttttctttggattttttccttcgtcttcgggtgtcttatcaggcttcctgggctgatcctttgaaacgcgcaacggttggttattcatggggtaactcctcaggataggcagcgatatactgctttgaaagtatagagtcgccgccatacgtgcgcgagcgcagcgacaaggcgcgtcagggaagaagagaaggcagtgataacgccaggtgacggaatttgcacgcaattcctggcttcaggggccgcccagcgtaaattaaagaattgtaaacaatcagccgttttgccgaagacttattctgcccacgacggtttatttaaaatatgatcctgccagtcccgtacttcagattctttaaccgcgatatgacggacagaaattcgctcgccatgcatagcagctttcgatccagtcagcagcggatgccacgtcggcaagggcttaccttccgccaacaaacggtaggcgcaggtcatcggcaaccattcaaagtctggcaagttttcgcgagtgagtttgatacagtcgggttcaaattcaaaacggcgctcataatgacggcactggcacgttttgatatttaattgcctgcacgccacgttggtgaagtagatttcatctgtatcttcatccatcagcttatgcaggcagcattgaccgcagccatcgcacagcgactcccactcggcatcggtcatttcatccagggttttacgttgccagaaaggtgtatcgctcattaaagtatccgccattgcactaaagctgcaccttataaccagtctggcctgcagatgcaagttttaccgccgctgaaggcggcaagcagattttacagaacgcgggtagacaacgtttcgccattaaaacgaatgtccagctcatcgccgcttaataatggccccacgcctgccggcgtgccggttagcaccacgtccccggctttgagcgtaaaatagcggctcatataggcgataaggggcacaataggatgaatcatatccgcggtcgacccttgctggcgaacctcgccattaacgttaagtccgataaccgtattttgcggatcgccgcagaaggccgcgacagggatgaagcctgaaatcggacatgcgttatcaaaacctttggctttttcccagggctgtccggcctttttcattttcccttgaatatcgcgcagggttaaatcaagcgccacgccataaccggctatcgctttacgtacatgatcttcggtcgcctggcggagcgttgcgccaatcagcacagcaagctcaacttcatgatgaacagcccccatatccgccggaatcgccagcggctggcgaatatcacacaatgcggtttccggcttgataaaaagcacgggttcttccggcgtcgcgctgcccatctccttgatgtgatttgcgtaattactgcccacgcagaccactttacttaccgggtaatcaagcaaggcgccttgccagttacgatgttgatacatattttcccctaagatcatgatggaattcaggcgcggcgccgaataccgtttaacggtcagcgggcgacgtattttgtcctaccgaagaaagatgttgtttcagcaaatcttccggcggcggcggcaattgtaaataatagccctgctcgcttaacgcctgttttactttttcgagctcggcattgactaattttttacgtccatcaagcggcagcatcatcgctaactgcggctgaccgaatcctttcatcaacgcttcaggcacccgcgaaaaatcgtcttttttttcgacatacaaataggtttgatcgcgcttgctacttctatagatcacacaaaacatacttttactctgaattaacgggatggtgacttgcctcaatataatactgactataacatgccttctggacttcggaatatcactccgtatcggagatgataaatagcaaattgagtaaggccaggatgtcaaacacgccaatcgagcttaaaggcagtagcttcaccttatcagtggttcatttgcatgaagcggaaccagaggttattcgtcaggcgttagaagacaaaatagcgcaggctcctgcgtttttaaaacacgcccctgtcgttattaacgttagcggtcttgaaagcccggtaaactggccggaactgcataagatcgtgacctcaaccggcttacgcattatcggcgtgagcggctgtaaagacgccagcctgaaagtagaaatcgatcggatgggtcttcctttactgactgaaggtaaagagaaagcggttcggcctgcgcccgttgagccggcaacgcccagcgaaccgccgcaaaacgctaatcccatcacaaaaacgcgattaattgatgttccggttcgttccggtcagcgcatttatgctccacaatgtgatctgattgttacaagtcacgtcagcgctggcgcagagcttatcgctgacggcaatatccatgtctatggcatgatgagaggtcgcgcgctggcaggagcgagcggcgatcgggaagcgcaaattttttgtacccatctgacggcagaactggtctctatcgcaggtgtttactggctgagtgataaaatcccggcagaattttatggcaaagcggcgcgcctgcgtttagcagacaacgctttgacagttcaaccgttgaattgatccctttttaacaaggaatttttatggcacgcattattgttgttacttcgggtaaagggggcgttggcaagaccacctccagcgcggccatcgctacaggtttggcccagaagggaaagaaaactgtcgtcattgattttgatatcggactgcgtaacctcgatctgattatggggtgcgaacgtcgtgtcgtttacgattttgtaaacgtcattcagggcgatgcgacactgaatcaggcgctgatcaaagataagcgtactgaaaatctcttcattcttccggcgtcgcagacccgggataaagacgcgctaacgcgcgaaggcgtcgctaaggtactggactcactgaaagcgatggactttgagttcatcgtttgcgactcgccggcgggtatcgaaaccggggcgctgatggcgctctattttgccgatgaagcgatcatcacgaccaacccggaagtctcttctgtccgtgactcggaccgtattctgggtattctggcatcgaaatctcgtcgcgcagaaaatggcgaagaaccgattaaagaacatctcctgttgacgcgctacaatccaggccgcgtcaataaaggcgacatgctcagcatggaagatgtactggagattctgcgtattaaactcgtcggtgtgatcccggaagatcaatccgtactgcgcgcatcgaaccagggcgaaccggtgattcttgacgccactgcggatgcgggtaaagcctatgcagataccgtagatcgtctgttgggagaagaacgtcctttccgcttcattgaagaagagaagaaaggtttcctcaaacgcctgttcggaggataaattatggcattactggatttttttctctcgcggaaaaagagtaccgctaatattgcaaaagagcggttgcaaatcattgtcgcggaacgtcgccgtagcgatgccgaaccgcattatttaccgcagttacgtaaagatattcttgaggtcatttgtaaatacgtacaaatcgatccggaaatggttaccgtccagcttgagcaaaaagatggtgatatctccatccttgaacttaacgtaacgctgccggaagccgaagagtcaaaataagctcttttatgggaaaattcctggattaaaaaaggcagaagaatctgccttttttatttttttacattattccgaatacggacatttatttcactggccgttttcccggcaattaccgtcgttaaagcggatactcctgcaacagaagagttaacttctcctccatcagttcggcgcgccagccggaaatcaattccggttgcccattttgcggttttaatttccagtgccagttaagcaactgattaatctgccgacgcgatgccagtagctcgccgctgacgtgatgcgacgcgctcacctccgccaccagcgctttgatggctttaaacgctttgcgatagcccggcatgtccatcagattcaacaggggttccggcaatgcctcttccggtagcgcctgtgctttcgccaccagcgatatcaacgtcttgccatgaaaacgaatctcgctgccggaaagccccaggctatccagctcaccgagactgcccggcatataacgcgcgaccgcccacagattttcttcacgcacaacaaagttcaccgccatatcgcgctcacgcgccttacgtagccgccagtcagctaaaagttgcagacaggctaactggcgagtacgcagttgccaggcattggtgatatcccgccatgcttcttccggcgcctgaatctcctgacggcgctgctgcatcaaccgacactcatcaagcgcggcaggcagccatcctgcggcttcagtttcaatcatcagctttttggcgatcggtaacagataccagacatccgccgccgcgtattcacactgacgttcgcttaaaggccgggctaaccagtcggtacgagactcgcttttgtccagcgccacgcccgtatactcttctaccatcgacgcaaaaccccacgacagcggacgcccgcaaaacgccgccagaatttgcgtatcaatcaggggttccggcagttcgccaaacgcattcagaaatacttccagatcttcgctacccgcgtgcagaaatttggtgattcccgtatcgcgcaacaccgcttttaacggcgaccagtcgctgatgccgagcggatcgatcagggcgacatttgccccgtcaaataactggatcaatcctaactgcgggtaataggtgcgggtacggacaaattccgtatctaaagcaatagccggacatgcgcggacagcctcacacaggctcgccagcgcatcgtccgtttcaatcatttggtaattcaaatcgtgttctctttggttcgcgccaaaaaaaacgccggcttaaccggcgtctctcgttagctgacttaacgctcaggctttattgtctactttgccacgggcttcgtcacgcagttctcgtcgtaaaattttcccaacgttagattttggtaattcctcgcgaaactcgacctgtttgggcaccttatatccggtcagatggcgacggcagaaggtgatcaacgcatcgtcagtcaatgccggatctttcttaaccacaaaaagcttcaccgcttcgccgctactaccggaaggcacgccaaccgccgcgacttcctgcacgccagaatgctgcatcaccacatcttcaatttcgtttggataaacgttgaaaccagaaaccagaatcatatctttcttacgatcgacaatccgcagaaagccgtcttcatccataaccgcaatatcgcccgtatgcagccagccatctttaatgatttcatccgtcgcgtcaggacgctgccagtatcccagcataacctgcgggcctttcacgcaaagctctccggcctcacccggcgcgacttcgttgtcatcgtcatccaccagtttggcttctgttgacggtactggcaggccgatactgccgctgtgataatcaatatcatgcgggttgacgctcaccagcggggcgcactcggtcagcccgtagccttccagcaggtattgcccggtcagctttacccaacgttccgcaacgacgttttgcaccggcatcccgccgccggctgacagatgcagcgaagaaaaatccagctgttgaaactctttattattgagcagggcgttgaataacgtattaacgccagtcatcgccgtaaatggatatttcgccagctccttgaccagaccggggatatcacgcggattggtaatcagcaggttttgcccacccagctcgataaaaagcagacagttcatggttaaggcaaaaatgtgatacagcggcagcgcggtcactaccagctctttccccgggtgcagcagcggcccataggtcgctttcacctgctccagattcgccagcatattgcggtgggtcaacatcgcgcctttcgccacgcccgtcgtaccgccggtatattgcaggaaagccagatcttcagcgacaacctcgggtttgacatactgcatacggtagccatgctgtagcgcgctgcgaaacgagatcgcatctggcaagtggtattttggcaccagacgcttgatgtatttcacgacaaagttaacaaccgtacctttggcggtagaaagctggtcgcccatccgcgtcagaataacgtgctgtaccgacgttttctcgactactttttccagcgtatgggcaaagttagaaacaataatgattgccgccgcgccgctatcgttaagctgatgctcaagttcgcgcggcgtgtacagcgggttaacgttcaccacaatcatgccagcgcgtaaaataccaaatagcgcgacaggatactgcaacaggtttggcatcatcagcgccacacggtcgccttttttgagtcccagcccttgttgtaaataagccgcaaatgcccgactacgttcttctaatttacggaaggtcattacctcccccatattgacgaacgcaggctgatcggcatagcgcgtcgccgcatgttcaaacagttcaaccagggattgataacggtcagggttgatctccgccggaacatcagcaggataacggttaagccaaaccttcttcaatgcatcacctctaaaatgagtgttcgtcgtcatcacaaccccagttaataaacaagtcgttaacattatattaactcagcgtaccagtttattaattacgcaactgaaaggttgcgaagcgcgtcactatttatttttattatgtctctatgaatgcagaaacagcggaccagccgctgtttcttttattgataaaacaaagagttactctgttactatcgtctgaacctccgcgggtccagggttataccatccccaaccgccatagccataaggccaggcgcgtccgccgtaaaaccacggatcgatcggctgtggaggcatgacgacctgctgaacaagatgccagcgtttatagccggtagcctgcatcagcataaatttatacggcgtattgccgattttaccgtcaaccgtgccggttatcgggccgacaacggtaactaactggccacggaagtccaccgggtccagaaaaccgttcacatcggcaaaaattctgccgcgcgaggcttcgcccagaacaggacgcgcgccgctatcaagcggtacggtcgcgatttcaagccgggtttttccctgctgattttgcaccgccacaactttgccgccaaaacgcgcctcttgcccgatatagagctgcggcgcattcatcacccgcaccaaatcctgctgcggcgtcggactcgaacctttaatggcatccgggatagtcacgcaaccgctcagcataagcgcaaaagcgcacgccagcgccccttttattaaccgtttttgaaccgccatgatgcgactcctttttctcgacctctattccaccccacagcataaagtatggggggtaatagtagtgagagtcattctttgccgggaagtttcttccacgccacttcgttacgcaaataaaccggctcggcatgttccacggcaacggtctctcctgccgccagcttttgactggcgatgggcaacatatcttccgctgccgggagcgacacctccccatcatgaagcgtcaggccgcattccttcgccagatcgggccacgcggaccaacccgttcctacggtcgcccactcgccggaaagctgtttcaaccgctcgccgacccgttccggtttcagcaccgcttccgtctcttcgccctgccagacgccctgcgcatcacgctggtattccgcccagtacacttcgcccatccgcgcatcaatcgcggcgagtacgcgggtcgcgccggttttacgccatgcaccctgcgccatcgtggcaagcgttgaaacaccgatcatcggcagatttgcccctaacgccagcccttgcgcaataccaatgccgatacgcacgccggtaaagctgcccggaccgcgcccaaacgccagcgcatctatctcattgagcgaggcgccgctggcggccagaatctcctgcaccatgggcaggatacgttgagtgtgttctcgtggacaaagctcaaagtgagcattgatagtaccgttgttccacagggcgacagaacaggcctctgtggcggtatcgatagccagaattcgcatgaggtttcgtgcttagatcaataaaatagcgcgcatcttaccatactccgtaacaaattactcggcggatggaatcgcaagaaagcgaacggcacgggcgatatcacgcgtgcgcggcgcaggaggcaggctggcgagaaacgtggcgccatagggccgcatcaccagccggttatcacaaatcactaacaccccgcgatcgtccgcatcgcgaatcagccgccccaccccctgcttcagcgtaatcaccgcgtcgggcagttgaacctcatcaaacggatcgccaccgcgcaaacgacagtcttccattcgcgcttttaacagcgggtcgtccggggaggtaaacggcaatttgtcgataatcaccaacgataacgtatcgccgcgcacgtccaccccttcccagaagctgctggtggcgacgagcagcgcgttgccggcgctaacaaattgctgtaacagttggcctttactggtttccccttgcaacaataccggcagcgtcatggtggcgcgaaactgctccgccaaatcgcgcatcatggcgtgtgaggtgcacagcataaaacatcgcccgttattggcttcgataatcggcctgagcatagccgccaactgtcgcgccgcgccgggctggttggtttgcggtaggttacgcggtacgcagagtaacgcctggcgcgtatagtcgaatgggctgggcagtagcatggattctgcctgttcaattccaagacgggcggtaaagtggtgaagatcatcatttaccgacaacgtggctgaggtaaaaatccagctaccgggcttctgttccatcacctctttgaatttgtccgccacggtgagcggcgtcagcgccagggtgaaatggcgcgaggtgcactcataccagtagctgtatcccggctgattgatctcttttaagcgtttcagccgtgaacggtatagcgtggcgcgttcaaaagccgcatccagcagcgccgaacggcccagcgacagcttcgccacgtcgtaacaaagctccagcgtatcatccagcagtaaaaatgcccgttggatacgtgagtcggctaacagttcacgcaaatttccccggtagccgggctcccccagttgcagacgaaaatcctgggcgctctgggcaaggcgatcggcgcatttttgcaactgttgagtgtctttcagttccgtccggtaggcgatggtgatgtcttttgctaaatccagcaactgacggctggagagcgattgtccgaaatactggctggcgatgtcaggcagttggtgggcttcatcgaagatcattacttcagcctgagggataagttcgccaaacccgctctctttaaccaccatatccgcaagaaataggtggtggtttacaatcaccacatccgcgtccatcgcctttttacgcgctttcaccacaaagcactctttgtagagcgggcaatcgctgccaaggcagttgtcgttggtactggtgaccaacggccaggcctgggaatcctccgccacgctgacgcaggtgctgatatcgccatcccgcgtctgatttgaccaggagcgcagcaatatcacgtcgcttaacgtttgtaccggtaaatcgccgcccgccagcgcttgttgttccagccgctccaggcagaggtagtttgaacgtcctttcaacagggccgtcttaccggtaaacgccaacgcttttgctaccgtcggcagatcgcggctgtagagttgatcctgcaacgctttcgacccggtcgaaataatgacttttttcccggcgcgcaacgccggagcgaggtaagcataggtcttcccggttccggtgccggcttcaacaaccagaggctgcgcattttcaatcgcttgtgttacggcaaccgccatttgtcgctgtggttcgcgcggtttaaagccggttatcgctttggccagttggccatctgctgcaaaatcgtccgtcacactgccccctgttaatttgcacagggattatgtcagggtagaaaggcttacgccagttacagaggtgacggcggcgccacattgtggcagtcttgaaccattcaaatgaaaagcaaatgaggaataagtaatgtctatcgtgcgtattgatgccgaagatcgttggtcagacgtggtgatctacaataatacgctgtggtataccggcgtgccggaaaacctggacgccgatgcttttgagcaaacggcgaatactctggcgcaaattgatgcggtgctggaaaaacagggctccagtaagtcacgtattctggatgccactatttttctgagcgataaagcggattttgccgccatgaataaggcgtgggatgcgtgggtcgtcgcaggccatgcgccggtacgctgtaccgtacaggccgggttgatgaacccgaaatataaagttgagattaagattgtcgcggcggtataagccggttattcgtcttcatcctcaaaacgcgccactatccgttcgccggtatggttggcgcgaagttcgcccgccacctgggcaatcgcttctccgctactcataccttgcgacatcaattcctggatacgttctacggctttttgctgttgttcatgactgagtgaaggtaaacctgcaaacatgattaactcctgctaaattgttagcgctaattatttcacgctacccggcggtaagccagtagtgttgtaacgagtcaggaatgatgaagacgttatctcccactgttatcaccttaccctggcgtccggacgccgctgaacactattttgcgcccgtaaaccatttgccctgggcgatgctgctgcattcaggtgatgctattcatccctataaccgttttgatattctggtcgccgatcctgtcaccacactgaccacgcgcgcgcaggaaaccacggtatgtactgcgcgcacgactaccgtcactctcgacgatccgttacacgttttgcagactcaactggaggcgctgccttttcatcctcagcctgaccctgacttaccctttcagggcggcgcgctgggtctgtttggttatgatttagggcggcgtttcgaaattttgcccgatactgccgcgcgcgatatcgctttacccgatatggcgattggcctttacgactgggcgctgattgtcgatcaccaaaaacaggtggtgtcgctgataagctatcacgatgcagacgcccgatatcgctggctcaccagccagcgcgcgccgacccgcacgcccttcaggcttacctcagcctggcaatccaatatgacgcgttgcgagtatggcgagaagtttcgtcaggtgcaggcctggctgcacagcggggactgctatcaggtcaatctttcccagcgttttcaggcgagctacgagggtgatgaatggcaggctttcgaacgccttaaccgcgccaatcgcgccccgttcagcgcctttcttcgtttacatgacggcgccatattgagcctttctcccgagcgttttatccaactggagaatggtcatatccagacgcgcccgatcaaaggtacgcttccacggcttaacgatccgcaggcggatcgtcagcaggcgcagaaactggctaattcaatgaaagatcgcgctgaaaatttgatgattgtcgatttgatgcgtaacgatattggccgggtcgccgtaccaggttcggtgaaagtgccggaactgttcgtcgtcgaaccatttcctgccgttcaccatctggttagcaccattaccgcccgtttaccggactcgcttcatgctaccgacctgctgcgcgcggctttccccggcggctccattaccggcgcgcctaaagtgcgggcaatggaaattatcgacgaactggagccgcagcgacgcaacgcctggtgcggtagcatcggttatctgagtttctgcggcaagatggataccagtattactatccgcaccgtcacggcaacgcagggccaactctattgctcagccggcggcggtatcgtggccgatagcaacgaagaagcggaatatcaggaaacttttgataaagttaatcgtatcctgcacccactggagaactaatacgtggataccagccgtctgacgctcgatcatttcttatcgcgctttcagcttttgcgcccgcagatgactcatgaaacgttaaatcaacgtcaggccgccgtactgatccctgtggttcgccgcccccagccggggctgctgttgacccagcgggctattcatttgcgcaaacacgccggacaggtcgcctttcccggcggggccgtggacagtaccgatgcttcgcttatcgccgcagcgcttcgcgaagcgcaggaggaagtcgccatcccgccgcaagccgtggaagtgattggcgttttaccgccggtagacagcgtgaccggttttcaggtcaccccggtggtcggcattattccgccaaatctcccctggcgcgccagtgaagacgaagtgtctgcggtgtttgaaatgccgctggcgcaagcgttgcaactggggcgatatcatccgcttgatgtttaccgtcgcggcaattcgcaccgcgtatggctctcctggtatgagcattatttcgtctggggcatgaccgcaaacattcttcgtgagctggcgctgcaaattggcgtaaagccctgactgtacacaacgccattcacgttgcctcaaggcggtaacaatcgcctcccccaaagaggcagcctgaagggcaacgtgtatatacttaactttacgcgcgtaagacacgacttgagattactgtcgcaatattagtaaaaacgcggttattcattagtttaattcatgtgaatagttaagctgatgccagcgttccctcttacactatgcgcagttataacatcgtaaccggaagccccggttgccctgtcaggagtattatcgtgattagcctattcgacatgtttaaggtagggattggtccctcctcttcccacactgttggcccgatgaaggccggtaaacagttcgtcgatgacctggtcgaaaaaggattactggataacgttacccgcgtcgctgtcgatgtctacggctcgctgtcgctgacggggaaaggtcaccataccgatatcgccattattatgggtctggcgggtaatgaacccgctaccgtggatattgatagtatccccggttttattcgcgacgtcgaaacgcgcgagcgtctgttactggcccagggacgtcacgaagtcgacttcccgaaagatgacggaatgcgttttcacaacggcaatttgccgctgcatgaaaacgggatgcagatccacgcctggcatgacgacacggtcatttatagcaagacgtactattccatcggcggcggctttatcgttgatgaagagcatttcggccaggaagcgacgaatgaggttactgtaccttatccgtttaaatcggcgaaagaaatgctggagtattgcaacagtaccggcctttcactctccggcatggtgatgcaaaacgaactggcgctgcatagcaagaaagagattgaagagtatttcggtcacgtctggcagaccatgcaggcctgtattgatcgtggtatgaataccgaaggcgtgctgccggggccgctgcgcgtaccgcgtcgcgcctctgcgctgcgtcgtatgctggtttccagcgataagctttccagcgatccgatgaacgtcattgactgggtgaacatgtttgctctggcggtgaacgaagagaacgccgcaggcggccgcgtcgtgacggcgccaaccaacggcgcgtgcggtatcgttcctgcggtactggcttactacgaccattttattgaatcagtcagcccggatatttacacccgctacttcctggcggcaggcgctattggcgcgctgtataagatgaacgcgtctatttccggcgcggaagtcggctgtcagggcgaagtcggggtcgcctgttcgatggcggcggcaggccttgctgaactgttgggcgccagcccggagcaggtttgcgttgccgctgaaatcggcatggagcataacctggggctgacctgcgacccggttgccggtcaggtgcaggtgccgtgtatcgagcgtaacgccattgcttcggttaaagcgatcaacgctgcgcgtatggccatgcgtcgaaccagcgcgccgcgcgtctcgttggataaagtcatcgaaacgatgtacgagaccggaaaagacatgaacgcaaaataccgcgaaacgtcgcgcggcgggttggctattaaagtccagtgtgattaaacgccgtttcccctcccttcgcccatctgctacggatgggcgaaatttttatctcttcctcgtcgactccacgtttccccactacacttgctgtgtcgcggttggcttttgtcgccaacgcttattgggcggcccgcatgcaaacagcacaacggatcatcaatcattatcgccgtaatcgtttcattgtttgcacgatttgtgcactggtcacgctcattcttacgctgagcatccgatttatttcggagcggaacttaaatcaccatcgcacggttgcattcgcgaatcatgccgttgatgcgctggataatgtgctgcatcctctcctggtcggacgaaacatactgctccccttgcttgagcttccgtgcgcgaccgcgcatttgccgttgcgtaagcaagccgcccgcctacaaaccattcgttctatcgggctggtaaaagagggaattctctattgctcaagcatttttggcgcccgtaatactcccatacgccagcttcagcccgatcttcccgcagtcggcgatctgctgctactttccacagaccaatcgttactcaagggaagcccgatcctcattcagtggtatcccgcctctgccgatggccaggatggcgtgatggaaattgtgaatattgacttgctgacgactatgctacttgagccgcagcagccgcaaattaccagcgccagcctgacggtcggcaaacgacacctgttatatggtcggggcgtggtcgatactcttccggaattaaaaaaagatgaagagcgttaccagctttcatcgcgacatttcccttttactatcagcgtcagcgggccgtcggcaggcgtactggcgttcaaacatctcccgacgcagttaccgctggccgtattgcttagcctgttgatcggttatatcgcctggctggcaacggccagcagaatgagcttttcctgggaaattaatctggcccttgccgaacgggagtttgagctattttgtcagccgttgcttaatgcccgcacgcagcagtgtaccggcgttgagatcctgttacgctggaacaacccgcgccagggctggatctcaccggatgtttttattcctatcgccgaggaacataacctgatagcgccgctgacccgctatgtgattgcggaaaccattcggcagcggcactacttccccatcaaccatcagtttcatatcggcatcaatgtagcggcaagccatttccgacacggcgtgcttctcaaagatcttaatcagtactggtttagtgcggaacctgttcagcaactggtgctggagctcacggaacgcgacgcgttgcttgacgttgattaccgcctgatgcgcgagctgcatcgtaaaggcgtgaagttagccatcgatgattttggcacaggaaacagctcgctctcctggctggaaaaactgcggccggatattttgaaaatcgataaatccttcaccgccgccatcggtaccgatgcggtcaattcaacggtgaccgatattattatcgcgctggggcaaagactgaatattgaactggtggcggaaggggtcgaaaaccagacgcaggcacagcatttgcgccagcatggcgtgcaaatgttacagggctatctctatgcgaagccgatgcccattagcgaatttccacagtggctggcgggcagcgcgccgccgcccgcccggcataacggacagattatgtccgcgatgccgcatctatagacttgattcctgcgtgtgacgttattcctcttcgtcgtgggcaggctgttctttaacaattcgaaccagatcgacacgatagtcgttggcctcgacaatggtgatccgcaggggcggaacatcaatgacatcgcctacacgaggaatatggccattagcggcgatcactaaccccgcgaccgtcgcaatatcgccctcttcgttcaccagatggtcaacttccagcgcctgctgtagcgcatggagatcggtgccacccttcactatccagccctcggcatcggcaacgatttccggcgtttcatcggcatccgggaactcaccggcaatcgcttccagcacatccagcggcgtaaccagcccctgcaccacgccgaactcgttagtgacgataacgaaactgccgcgcgcgcggcgcaaaacgcctaacagattgataggatcaagcgtttccggcaccactatcgccggggaagacgcggcgatagccgcaacatccgcgccctcttccagcgccaccagcaactctttcgcgcgaacgataccgataatttcatccagctcgccccgacataccgggaacaggctatgcggagaagagagtaactgctgacggatttcagctacgctgagattcgcatccacccaactaatttcgcctcgcggcgtcataatgccgcgcagggagcgcgacgccagagtcagtacgccgttaatcatgtagcgttcttcttcggcgaaggcgccttccgacaccgatatcgcggccgggctatccgtttcatgttgcgtactcgcctggcgtttaccgcccatcagacgcaggatagcgtccgcagtacgcgcgcgcagcggcaacgtggactgatgacgaataaagttgcggcgcgcaatctggttaaacacctcgataacgatcgagaaaccaattgccgcgtacaggtagcctttcggaatatggaaaccaaacccttccgccaccaggctcaagccgatcatcagcaggaaactcagacagagcaccaccaccgtcggatgctggttgacaaaacgggtcagcggttttgacgccagtagcatcaccgccatcgcaatcaccaccgccgccatcataaccggcagatggtttaccatacctaccgccgtaatcacggcgtccagcgagaagaccgcatccaggatgacaatctgcgtgactaccacccagaagctcgcatagcctttaccgtgtccggtgtcatgctcgcggttttccagacgttcatgcagctcggtggtcgctttaaacagcaggaatataccgcccagcagcataattaaatcgcggccggagaaggtaaaatcccagacggtaaagagcggctttgttaaggtcaccagccacgaaataatggacagcagcgccagacgcataatcagcgccagcgagagcccgataagacgcgctttgtcacgctgctttggcggcaatttatcggcgaggatcgcgataaagaccaggttatcgatacccagaacaatttccaggacgacgagcgtgagtaaacccacccaaattgagggatccattaataattccatgacaagctcctgcttaaggaatgactaaacggcgcccacaacatctcaaaggatgcaggcggtaacgcaataaacaaagtaaggctatggcaagatatgccagattgacaggcgcaaaacggccaaagagtgaaatgacgtcggtgacgatccatacaacgggctgctgccctataccccattctaattaaacggaagctaaacataacagagacaactggtttttggcaaagatttaccttcctttgcaaagagatgtaaccaggatattttacacttcgaaatttctcattatcgaaaacaaaattacggatctccatcacacaaaatatttttttcgatatctaaaataattcacgaaaatcatgcgtttttcgttgtaaccctcatctgaatcgattcgcttgcggacggcgattcaaaaaatacatctgtcaagttgatgtgttgacaataataaaggaggtagcaagtgaccattgctattgttataggcacacatggttgggctgcagagcagttacttaaaacagccgaaatgctgttaggcgagcaggaaaacgtcggctggatcgatttcgttccaggcgaaaatgccgaaacgctgatcgaaaagtacaacgctcagttggctaaactcgataccagtaaaggcgtgctatttctcgttgatacatggggaggcagtccgtttaatgctgccagccgcattgtcgtcgataaagagcgctatgaagttattgccggcgtcaacatcccgatgctggtcgaaacgtttatggctcgtgacgacgatccgagctttgacgagctggtcgcactggcggtagaaaccggtcgtgaaggcgtaaaagcgctgaaagcgaaaccggtagaaaaagccgcgccagcgccagtcgccgccgcgccaaaagcggccgcaccggcaaaaccgatgggcccgaatgattatatggttatcgggcttgcccgtattgatgaccgcctcattcacggtcaggtcgctacccgctggaccaaagagaccaatgtcagccgtattattgttgtgagcgatgaagtggcggcggataccgttcgtaaaacgctgctgacgcaagttgcgccgccgggcgttacggcgcatgtggttgacgtcgcgaagatgattcgcgtctacaataacccgaaatacgccggcgaacgcgtgatgcttctgtttaccaatcctaccgacgtcgagcgcatcgttgagggcggcgtgaaagtcacttccgtgaacattggcggtatggcctatcgtcaaggtaaaacgcaggtgaacaacgccgtttccgtcgatgaaaaggatatcgaagcctttaaaaagctcaacgagcgcggcatcgagcttgaggtgcgtaaagtttccaccgatccgaaactgaaaatgatggatttaattgccaaagtggcgaaataaccgccggcatttaattagctttcacacttaagatagcaataggagaagtacaatggagattaccactcttcagattgtgctggtgttcatcgtcgcatgtatcgcgggtatggagtcggtacttgatgaatttcagttccaccgtccgctgatcgcctgtaccttaatcggcgccgttctgggggacatgaaaaccggtattatcatcggcggtactctggaaatgatcgctctgggctggatgaacatcggtgctgccgttgcgcctgatgccgcactggcgtccatcatctctaccgttctggtcatcgccgggcatcaaagcattggcgccggtatcgcgctggcgattccgctggcggcggcaggccaggtactgaccattatcgttcgtaccatcaccgtggcattccagcacgcggcggacaaggcggctgaaaacggcaacctgacggcgctctcctggctgcacgtttcttctctgttcctgcaggcaatgcgtatcgctatcccggcggttatcgttgccatctccgtaggcaccagcgaagtacagggaatgctgaatgcgattcctgaagtcgtcacaggcggtctgaacatcgccggcggcatgatcgtcgtggttggttatgcgatggttatcaatatgatgcgcgcaggctacctgatgccgttcttctacctcggtttcgtcaccgcggctttcacaaacttcaacctggtcgcactgggtgtcatcggcgcagtgatggctattctttacatccagctgagcccgaaatacaaccgtgtagcgggcgcgcctgcagcggctgctggcaataacgatctcgataacgaactggactaacaggtgagcgaaatggttgatatgactaaaactaccaccgagaaaaaactcactccgagcgatattcgcggcgtatttcttcgttctaacctgttccaggggtcatggaacttcgaacgtatgcaagcgctgggcttctgcttctctatggtgccggcgattcgtcgcctgtatccggagaataatgacgcgcgtaaacaggcgattaaacgtcacctggagttctttaacactcatccttacgttgcggcgccggtactgggcgtgaccctggcaatggaagaaaagcgtgcgaacggtgcagagattgacgatggcgctatcaacggtatcaaagtcggtctgatgggaccgctggcaggcgtcggcgaccctatcttctggggtaccgtccgtcccgtattcgcggcgctgggcgcaggtattgcaatgagcggcagcctgcttggtccgctgctgtttttcatcctgtttaacctggtgcgtctggcgacccgttattatggcgtggcttatggctaccgcaaaggcgtcgatatcgttaaagatatgggcggcggcttcctgcaaaaactgactgagggggcgtcaatcctcggcctgtttgtcatgggggcattggttaacaagtggacgcatgtgaatatcccgctggtggtttccaccatcaccggtcaggatggtcagacacgcgttaccaccgtgcaaaccattctcgaccagctgatgccgggtctggttccgctactgttgacctttgcctgtatgtggctgctgcgtaagaaagttaacccgctgtggattatcgtgggcttcttcgtcattggtatcgccggctactccgtaggactgctgggccagtaaggctgttgtacactaccggggccaaacggccccgttttttatttctctggaggataaatgactatcacggacctggtgctgattctctttattgccgcattattggcttacgctctctacgatcagttcatcatgccccgtcgcaatggccccactctgctttctatagccctgctccgccgcggtcgcgtagacagcgttatcttcgttgggctggtcgccatccttatttataacaacgtaaccagccacggagcgcagatgaccacatggttattaagcgcgctggcgttaatggggttttatatattctggatccgcacgccacggatcatctttaaacaacgtggctttttcttcgccaatgtctggatagaatataaccgtattaaagagatgaatttatcggaagacggcgtactggtgatgcaattagaacaacgacgcttgcttatccgtgtacgcaatatcgacgatctggaaaaaatatataaacttcttattgaaaatcaatatcttaagatatagcctcaactatgtttttcgaattttatttcgaatcataatatagctaaggctatattttctattgaccaattgttatttaatttaacgttttattgatgaataaatctaaatgaaaatcgttttcaattgaaagacaaataatattttatcgctgttgttttatattctaaaaatatgttaatgttgcgccgtcaattggggagtagccgatttccagactccggaaatgtacgtgtcaacatactcgttgcaaaacgtggcgcgtacggaccagccgccgctggtcaggcgagaccataggcgcatcaactgctgtgtatttcgtcacagaatggcgacatgcatgtttgctgggggcagtgatgtgtttaatggataccccggtcaggacgttgtcatgcactttactgctactgttcttctcgctttcggcatgtcgatggatgctttcgcggcatcaattggcaaaggcgccaccctacataaacccaaattctcagaagcgttgcgtaccggtcttatctttggcgcggttgaaacgctaaccccgttgatcggctgggggctggggatattggcgagtaaattcgttctggaatggaaccactggatagcctttgttctgctgatctttctgggcggacgcatgatcatcgaaggtatccgcggcggtagtgatgaagatgaaacaccgttacgtcgtcacagcttttggctattagtcacgacggctatcgcgaccagcctcgatgcgatggcggttggcgtcggtctggcgtttttgcaggtaaacatcatcgctaccgcattagctatcggttgcgccacgcttatcatgtccaccctagggatgatgatcggtcgctttatcggcccaatgctgggtaagcgtgctgaaattctcggcggggtcgtactgataggaattggcgtccagatcctctggacgcattttcacggttaacggttacgctgccagagatgaaggttgaaatccgtctggcagctaagtccggcgctggcagccagttgttcccacacgtctggcctggcgcgccaggcaaatggcgtcatttgcaacagtgctacagccgcttcggcggtgagctgcatgtgataagcaaggcgggtactctgctgcaatgtgaatccgtcgagctgctcggtatacggcgcatgtaaacgcacctcatcataaatgagcccttttagttccatcagatgatgcggccctggcgtggcggtaacgacccaaccaccaggtttcaccacacgcgccaattcctgcgccttacacggggcgtagattctgatcaccgcatccattgacgcatcggcaaagggcagtcgatggcttgacgccacacaaaacttcacctgcgaatagcgtttcgccgccgctttgatcgccgttttagcaacgtccagtccaaacgtggtgactcccggcaacgcctcggcaaaagcatgagtgtaatacccctcgccgcagccgatatccagaatcgccgtggccgactgatccagccgctcgcgcaacaggttaatcacggcatcgcgcagcggctgataatggcctgcatcaagaaacgctctcctcgcctgcatcatttcggcgctgtcgcccggatcgcgcgaacgtttatgctgtaccggcagcagattgatgtaaccctctttcgccacatcaaactgatggcgctgtggacatataacgctgttattaatctgcgtaagcggctgatggcaaagcggacaggtaaacgacatgacaactccggactggggcgctaaagggcgcaagtgtaacgcgaattgcgccccgggaaaatcctttacgaacccggaaccgcaacgtggctgccatgcatcaccagaaggtgatctgaatcggctggcataccgtctggctcaacattttccagccgcagcacatcgcccatgatctggctgaatacgggcgcagataccgcaccgccataataagccccattttgcggattattaatcaccaccaccagcgcaaatctggggttacttgccggcgcgacgcctgcggtatatgccacatacttatcgacgtatttaccatcatcgccaatttttttcgccgtcccggttttgaccgcaatacggtagtctcttactgcggcttttgttccgccgccgccaggcaacgcgacgctctccatcatatgttccacctcgtgcaccagttcttccggcattacccgcgtgccgatcacgggcggatcaactttggtgatcgataacggacggtagataccaaagctgccaatcgtggcataaacatgcgccagttgcagcggcgtcaccattaatccatagccaaaagcaaaggtagcgcgatctaaatcactccagtaacggcgtttcggtaataacccgctgctctctccggtgagacccagtccggtaggcacgccgaaaccaaagcttttataagtatccattaatttctgcaccggcatcgccagagaaaggtgagaaacgccggtatcgctggatttttgcaaaatgccggttaatgtcagttccggatagtaaccgacgtcgcggatacggtgtccatcgagagtaaaaggatgggtatcgataacgctgtccggctgcacgatgccctgctgtaacgcagtcataatgaccaatggcttcacagtagaaccgggttcgaaggtgtcgctaatcgcgcggttacgaaaatcgtccaactgcgcgccttcacggttgttcgggttgaaatccgggtagctcgccatcgagagaatttcacccgttgggatgttaatcaatacggcagcgccggattccgctttgttccagatgacggcgttatccagcgcatcttcggtaaccgtttgcagacgttcatcaatgctaagctgaagttcatgagcaggaaccggattcacttccgtaatgttctcaataacgtgaccaaatttatctttacgcaccaatcgggagcccggttttcccgtcagttgcgcgttaaagctcttttcaataccttctattccctgcccgtcgatattggtaaagccgatcaaattggccgctacgtgtccggcagggtaaaaacggcgcgactcttcccgcaggttaatacccggtagattcagtttatctatccattcggcttgctggggtgaaacctggcgcgcaaggtagataaaacggcctgccgggttactgtttacccgttccgcaagcgtactgagagacagatgcagggcgctggccagcgcctgccagcgctcattgtagccaacgccgcctttgcttatgatagtcttcggatcggcccagacagcattaaccggaacgctcaccgctaagggtcgcccttctctgtcggtgatcatgccgcgtggagaggccgtggtcacttcacgaagcgagcgcatatcttcttgtttcaccagtttcgacggcgtaacaatttgcagccatgccacccgccctaacaacaatgccatactgagcagaatggcagtgcaaagtagtgcaaaacgtatgggcgtaaaattacgggtatcgccgtcgcttttctttttcacctgatctccagccgaatcatttttcaggtgattgatttaacgggaaacggccggaaaaaccagaaaaaacaatgctaataacatcgcgcctttgcaacaaatcgctaacgagagcgcatccagacacattttgaaggatattgaattaaaaagccccgcttttagcgaggctttatatctgaggctgacgcgacaaacgcatcaaatcagtggtgtcgatcagatagctgttacgttaacagcagccggacctttctggccgtcctgaatttcgaactcaacgttctggccttcagccagagttttgaaaccattgccctggatagcggagaagtgtacgaacacatctttgctgccgtcagccggagtaatgaagccaaaacctttggattcgttgaaccacttaacttgacctttaatctttgccatttgcaaaattccttagagtgttttctttgcccgtaggcataacatagataaaactgagacattactgcttgaggcactaatataaggttcggcagagaagcggtattcaacgtcaacgtgtttactcaggacttctttactgaaaatgccacacataaacagaactgtacctcgtttaacccaaagcctgttatcacatacaacgttaattatggcaagccatttttaaacgtgtctcgatccgtcgcacaaattacgagaaccttcacaaattgacagcacgtttatgcaacaaaattgcgaaagatatatcctcacgcgctgacggactcctgacaacgtcactgctgaaaagccatttttctaccatagctcaataacttcgcttcttccagtgcatcaaatcacatttaaaagctgtatttttcatatcactttttatgctgagttatgcataaattgtcacaatgataaaaaacaccttttaatcaaaataatagaaaagaaaagcgattttcggcaccgctttttgtgatgttctgcgtctttacagaatgccttaaaataatgaacaaacaatgacaatccataaagagagagaaacgtttcgcttttaatagagaatgagcggtatcacaaaaatgccatatgtccatttgttatacatataaaactatgttgcatataaagccatatattatgtaaggtgttgatgctgtagtatcagttgcaaacggcaacgcggagagatccgacggggaaatggggcgtatggcactggcgccatttgcgccccggtaagcattatcgttctgcaaccagacgaatgatgtcctcatcctcttttggttcgcttgccgctgttgcgggttccgcttctttttctggttcgtttgcttcgcaaaggcgacgtaacaacgcgttttgccgcttctgttgatccaataacgcttcgagcaattctatctgctcgttggcacgggagcttgcccggttgacaaagaaccagagcgccagccccaccaccagaaccaccattgatactattaaagatgcaagagaaaacgcaccagagtttaaaacgtcgttcatttcaccacctcaatgtagagacgtcattctaccactgctacacgggaaggaaatctctggtgtaaaacgtttaccagggaataaatttattgatggcgcaaataccgctgaaaaattgtacatcctgatcgcacatgatattaaacacctgcgcccacagcaacaggcatactaccaccacgatgccgagaacgacccatcgaaattttttcactccactctccgatcttacatcttatgtcgctaaattatcatgagttacttaaaccaggagtaactgtagcggcattatatgtttttaggaatgattcacttgtttcaatcaatgtacacgctactcttattctaactaaaaaagaaaagaggtagtaatgcgtttgatcattcgcgcaattgtattgtttgccctggtgtggataggcctgctgatgagcggctatggcatcctggtgggaagtaaagtgaacgctgcggggctgggtttacagtgccattacctgaccgcacgcggcaccagcacggcgcaatatctccataccaacagcggcattattggcttttccgactgtcccattttcagaaaaatcgccaccgtggtggataatggctaagcggcaataaataatttcacagtgaaactatcaccaataattcccctatattggctgttgttcataagtactgttaaataatattttaataaccgttaaataagccgacagatattatctacttttacgatttcatcccacccgatgttataaaaaaagcagctacatttttcgtagctgcttttttttaacgtcatgctaataacgttgcttagaagggataatcgttgtaacccatttgttcagaaattttacgcgcggcggcgtgtaacatagccacatattcctgtaggcgttcttctgaaaaacgcagcgtcgggaacgaaatgcttaaccctgcgatgactacgccaaaacggtcaaataccggtacgccgatacaacgtaatccttcttcctgttcttcgttatcttcaccgtatccttgcgcacgcacttcatccaacagcggcagcaacgcttcagtgctggtaatcgtgcgtcccgtgctttgcttatactctacgccgtcgagaatctgcttaacctcatcacggtcgcgccaggccagaagcactttaccgatggccgtactgtacagcggattacgacgcccaatacgtgagtacatccgcagattgtacatagagtcaattttatggatatagacaatgctgtcttcatccagcgcgccaagatggatagtttcttttgtcagacgagacagttcgcgcatctgaatgtccgcactgcggatgagatcaacattttgcaaagctcgcgcgcccagctcaaacagctttagcgtcagagagtatttttcagactccccctcctgagccacgtagcccagcgttttcatggtttgcaaaaagcgataaacggtgcttttcgacatcatgacgcgctgcgatagctcggtaatccctatttcacgctcttcacccagcgcctgcagaatgccgaaaactttcagcacagaagatacagaatcaggctgcttatccagatctgcgtttgccatttatcacctcattacgagcgttttataaaattcagaacgagtttttattataatttcacgccaggtcgcccgcaatccatctttgcttacttcgttacaaatctgcgacataacaactcagtattaatgctaacattattattcagctcataactccccttattacaaaatacttatggaaaaaacacgggccgatggcctgcccctcccgcagagatacggcgctatcctgacgattattatcggtatttcgatggcggttctggatggcgcaatcgctaatgtcgcgctgccaaccattgcgactgatttacatgcctcccctgccagctctatctggattgtcaatgcgtaccaaatcgccattgtcgtctcactgctttccctgtcttttttaggcgacatgtttggttatcaccggatctataaatgtggtttagtggtatttctgctttcatcattgttttgcgcgctttcagactcgctgcagatgctgacgctggcgcgcatcgcgcagggatttggcggcgcggcgctaatgagcgtaaacacggcgctgattcgtcttatctacccccagcgtcatctgggacgaggcatgggaattaactcttttatcgtcgccgtctcttccgccgcgggtccgacgatcgccgcggcgattttatccatctcatcatggaaatggctgtttctgattaatgtcccgttaggtatcatcgcgttaattctggccatccgctttttaccagcaaacatcgcccatgacactaagccgcgctttgacttaccgagcgcggtaatgaatgcgctcacatttggcctgctgattaccgcattgagcggatttgcccagggacagtcgctaacgttgattggcgcagagctgctcgttctggtcgtggtcgggtttttcttcgtgcgccgccagctttctttgcccgtccctttgttacccatcgacttgttacgcattccgcttttttcactctcgatcggcacgtcaatttgctcgttctgcgcgcaaatgttagccatggtctcgctacctttttatctgcaaaccgtgctgggccgtagcgaagtagaaaccggcctgttattgacgccctggccgctggcaacgatggtgatggcgccgctggcgggatacctgatagaacgtcttcatgccggtttgctgggggcgctgggaatggtgataatggcagccgggttgtttgcgctggtcatgttgcctgcctccccctccgatctgaatattatctggccaatgatcctttgtggcgcagggtttggcctgttccagtcgccgaataatcacaccattatcacttccgcgccgcgtgagcgcagcggtggcgccagcgggatgctgggcacggcgcgactgttaggccaaagtactggcgccgcgctggtagcgctgatgttgaaccagtttggcgatagcggtacgcatctttcgctgctcgcagcggcgatcctggcgattctcgcggcggtagtgagcggtttacgtattacgcaaccacgcgttcaggcgtaaaaaaagcgcgtcattcgacgcgcttttcatacttgccagtgggcttattatttcaggtactcgccgctacgcagcgcttcaatgcgtttatccagcggtgggtgcgtcataaacagctcgcttaacgatttcgatttaccgttaatacaaaacgccatcatgctggtcgcttcttgcggctcgtagctggttttcaggcgctgcaacgcggcaatcattttttcacgaccaaccagcttcgccgatcccgcatcggcatgaaactcacggtaacgggagaaccacatggtgataatgcttgccagaataccgaagaccagttccagcaccgtcgcaacggcgaaatagattagcggattaccgttacttccttcgccttcatcacggttgccgcccagaaaacctgcagcaatttgcgcgataatgcgcgaaataaagataacgaaggtgttaaccaccccctgaatcaacgtcatcgtcaccatatcgccattggcaatatggctgatttcatgcgcaatgacggcttccgcctcgtcagggctcatattttgcaacagaccggtgctcacagcgaccaatgaggcgtcacggcgggcgcccgtcgcaaacgcgttaatgtccggcgcatggtagatagcaacctgcggcatggcgataccggcctggcgcgcttgcgttgctacggtgttcatcaaccagcgttctctttcattgcgaggctgttcaataacttcccctcctacggattttaacgccatccatttggacatcagcaatgaaataaaagaaccgccaaaaccaaacagcagcgccatgatcagcaagccttgcacgctgctcgactgtatccccgtcaggctcagaaccagcccgaaaacgaccatcacggccaggttcgtcagcaggaagagcgcgattcgcatcataattttcttttaacctcaatttaacaaagcgcactatgcgattacccacatcgtatgggtcttatggctattttcaagcatcaccaggcggtaagtcacgagaaaaacacaactttacattttgtagcattatcctgacgacttctgcgcttgttaaaaaaaaacaggcacaattttttgtgcctgtttagcgttacttattggctgccgcctgctccgctggtttttctttttcaagatgcgccaggtccagagcaatcttcaccgtttcatcaaggtatgggtccggctcctggtaatcctttggcagatcgtccagtttcttcagcaacggtttaccctcgcgtttaaaccgatcgttaatacgcgccagacgcagagcgtcttcttcattgttctctttctcacgctgcgcataattcagagagacgatgttgcgcttatccttcatggcattgaaacgtgcgatatccttcatgatgtactggaactcaggatctttggcgatacgcgcgttgtgttctttcaataattccgggccaaacggggccaaatcgtccgatttcacgtatttcgccgcatcaatgctatcccacggcaaggcgttatcttcaaatttttctccggtttccgtctcttcattgccagtcggcatgatgatatccggcgtgacccctttacgctgcgtactaccgccgttgacacggtaaaacttctgaatggtgtactgcaccgaacccagcgcaggccattccgggcgaagcatctgatcgtaaattcggtttagcgaacgatattgctgtaccgtacctttaccgaaggtcggctcaccgacaatcagcgcgcggccataatcctgcatcgcggcagcgaagatttccgatgccgaggcactgaaacgatcgaccagcaccaccagcgggcctttgtagtagaccacgccgtcggtgtcgctatcctcacgcactttaccgttattgtcgcgcacctgaactatcggaccagaagggataaacagaccggaaagcgaaacggcttccgtcagcgccccaccgccgtttgaacgcagatcgataacgatgctgttaacgttctgtttttccagcttctgaagctgaactttgacatcatcggtcaagccaacatagaagcctggaatatccagtacaccaactttttccttgccgacggttttcaccgacattttaaccgcgcgatcttcaagacgaatccgttcacgcgtcagcgtgataatacgcgttttcgtccctttgccagccggcagtatttccagtcgaaccttgctgcctttcggccctttgatcagcgccaccacatcgtcaagacgccagccaataacgtcgaccatcggttttccggcctgccctacgccgacgatacgatcgccgacgctaatcgacttgctcttcgctgccgggccgccggcaaccaatgagttaatgacagtataatcgtcatccatttgcagcaccgcgccgataccttccagagacaggctcatttcggtattaaactgctcggtattgcggggagaaagataattcgtatgcgggtcgatttcacgcgcaaaagcggtcatcgccagcgagaacacatcttcactgttggtctgcgccaggcgacgaatagcgaatttgtagcgacgcgtcagcgtttcgcgaatttctttgtcgctcttgccggtgagtttcaggctgagctcatcgaatttcactttaccatcccacagcgcatttagctcagcctcatctttcggccagggcgctttactgcggtccaggttaaacgtatcgtttccggtgaaatccattggccgttccagcacttttagcgcgtactggtaacgttcaaaccggcgcttttgcgccaggttataaagatcgtaaaaaacatccagcttacccgtgcgcagctcatcgcccaacacggttttctttttcgcaaactgctcgacatcgctcgccaacaaaacgttgtggctatagtcgagaagattcagatagcgatcaaaaatctttgccgaaaatgcctcatccagatcgaactggcgataatgggagcgggtaaaacgcgacgttacgcgctcgctcaccgtcgcatgttgcgtctcttcctttagtacgggaatttgatcggcacgcgtaatatcttccacggcgaaggactggcctgctaatgcaagcaggccagctaacgcggtaagcctaaaaaaagtgttcatgccaggcctggcctccgtttcagaacaccaggtgttctgcgcgtacaatcaaagacatacccgaattcagctgtacacggacaccatctttggtgatttctaatacggtggcatccatcgcattattacccgctttcaccttgagggactgccctacggtcaatactgaaatatcagaaaccggcgtgtgcttctcttcgcgaggcgcacgcggcgctttcgtcgtcggtttatcagcgcgaggtttacgttcagcgccttctttacgacgcgctaccgggcgaggtttacgctcgcgtcgcggcgcgtcttctttttcgccagccgccgcggcagcttcgcgttttttcgcttgctgctctgcgcgctgcgcctgaacacgggctttggcttcttcaagctgcttacgcgcatgttcgacatgctgttcttccagctcgccgcacggattgccatcaaggtcgacgcgcgttgcgcccggcttaacgccgtacaggtaacgccagcttgaagtataaagacgtaaagcggaacgaagttgcgttttgctgaggttcatttcgcccccaactcgctctaccagatcctgaaaaataccaattttcagcgggcgagcttcgccttccgcactaaaacagtgaggaaaacgctcggccagaaacgcgataacttctttactgctattcaacttaggttgattttccatgaaatttcctgattacaacggacgtagccaacaagcagcaggcatgaacaggcgtcattataatgacgccatcagtaattgctacgttatccgttgattatcctgcgacgctcgcaaagaattttttgtaatccgtcgttgcaagcacggtttcaagctgtgcgaccagcgtacgcaggccgtgttcatcttcttcggtaaaacggccaaacgccgtgctatctatatccagcacgccgataatccgttcgccaaccgtgacaggcagcacaatttcggcgttgctggcggcatcacaggcaatatggccgtcaaacgcatgaacatcatcaatacgttgaaccttattctgcgctaccgctgcgccacacacgccgcgaccaaccggaatccgcacacaggcgattcgcccctgaaacggccccaacaccagcgtatcgccttcgaggagataaaatcccgcccagttcacctcggtaaggcgttcgaacagtagcgcgctggtattcgccagcgtggccagaaagctggtttcacctgccattaacgactgaaaatcgcggtttaacgccgcgtatagttctgttttgctcattatataatcacttcgtggtcttactcctaaacacaggctattaaaataagcattaaatgcgttcttgctcaagattattcctgtcatgagttaagattacattattctaacactttgattcacgatacatggctctgaacacctcacacgtcacgccaacaaaaaagctaacgatcaggtcaattagcgaagcgctgccgcgcagccactaccagcgctgccctgaatgcgacatgctgttcagcttgccggagatgagcgctcatcaaagcgcttattgtcctcgttgccaggccaaaattcgcgatgggcgcgactggtcgctgacgcggctgaccgcgatggcggtaaccatgctgctattgatgccgtttgcctggagcgaaccgttactccatatctacctgttgggcgtacgcattgatgccaatgtgatgcacggcatctggcaaatgacgcagcagggcgatccgttaaccgccgcaatggtgctcttttgcgtggtgggcgcgccgcttattctggttttttcaattgcttacctgtggtttggcagccttctcggcatgaatctgcgtccagtcctgctgatgctggaaaaactgaaagagtgggtgatgctggacatctatctggtcggtattggcgttgcctctatcaaagtgcaggactatgcctttctgcagccgggcatcgggcttttagcgttcgtctcgttggtggttcttagcattctgactatgattcatctgaatgtggagcaactatgggaacgattttatccgcagcgccctgctcaacgtgcggacgaaagattgcgcgtctgtcttggctgccactttagcggctatccggatgcgaaaggacgctgcccgcgttgtcatattccgctacggttacgcagaaaacagagcatacagaaatgttgggcggccttgctggcgtctattgtctttttgctgccggcaaacctgctgcctatctcggtaatctacattaatggcgggcgtcaggaagatactatcctgtcgggcattatgtcgcttgccagcagcaatatcgccgtcgccgccgtcgtttttatcgccagtattttggtgccgtttaccaaagtcatcgtgatgtttacgctactgttgagtatccattttaaatgccaacagggactgcggacgcgaattctgttgctgcgtctggtgacatggataggccgctggtcgatgcttgatcttttcgttatctcgttaaccatgtctctgattaatcgcgatcagattctggcttttactatgggaccggctgcgttttatttcggcgcagcggtaattttgactattcttgcagtggaatggctggatagccgcttactttgggatgcacatgagtcaggaaacgcccgcttcgaagactgaagcgcaaattaaaaccaaacgccgtatttcacctttctggctgctaccgcttatcgcgctaatgatcgcggggtggctggtatgggatagctaccaggatcgcggcaatagcgtgactatcgattttatgtcggcggacggtatcgtaccgggccgtactcccgtgcgttatcagggagtagaagtcggcaccgtggaagatgtcagtctgagcaaagatctgcgcaaaattgaagttcgcgtcagtatcaaatcagatatggaagatgcgttgcgcgaagagacgcaattctggctggtgacgcccaaagcctcgctggcgggcgtttccggcctggatgcgttggtcggcgggaattacatcggtatgatgccaggtaaaggcaagcccagagatcatttcgtcgccctggatacacagcctaaataccggcttagcaacggcgatctgatgattcatctccatgcgccggatctcggttcgcttaatagcggttcactggtctatttccgtaaaatccctgtcggacgggtgtatgactattcgattaaccctaacaaacagggcgtgacgattgacgttctgattgagcgacggtttaccgatctggtgaaaaaaggcagccgtttttggaatgtctccggcattgacgccgatctaagcctgagcggcgcgaaggtgaaactggagagcctcgcggccctggtcaatggcgcgattgcgtttgactcaccggacaattccaaacccgccgcccaggatgacacgttcggcttatataaagatttagcccacagccaacgaggggtaatcgttaaacttgagctgcccagcggagacggtctgaaagcggaatctacgccgctaatgtaccagggactggaggtgggtgagctttctaaactgacgctcaaccctggcggtaaagtcaccggagagatgaccgtcgatcccagcgttgttccgctgatgcgggaaaatacgcgtattgagttacgcaatcccaaactgtcgctaagtgacgcgaatatcagttcgttgttaaccggaaaaaccttcgagctggtgccgggcgacggcgaaccgcgcagtgaatttgtggtggtgccgggtgaaaaagccctgctgcatgaggcgaatgccttaaccctgacgctgacggccccggaaagttacggcatcgaaccgggccagccgttaattttacatggcgtaaaaattggccaggtcattgagcgcaacttatccagtaaaggcgtgtcattcatcgtcgcgattgaaccgcagcaccgggatttggtacagggcgacagtaaattcgtggttaacagccgggtggatgtcaaagttggccttgacggcgtagagttcctcggcgccagcgccagcgagtggattgacggcggaattcgtattttacccggtacgagcgggaagatgaaatccacctacccgctctatgctaacctggaaaaagcgctggaaaatagcctcagtgacttaccgactaccaccttaacgctgacggccgaaacgttgccggatgtccaggcaggttccgtcgtgctgtatcgaaaatttgaagtaggcgaagtcatcaccgttcgcccacgcgccaatacctttgacatcgacctgcatattaagccggagtatcgccacctgttaaccagcaatagcgtgttctgggcggaaggcggcgcgaaagtgcaacttaacggcagcggcctaacggtacaggcctcgccactctcccgcgcgctgaaaggggccattagttttgataacctgagcggcgccagcgccagccggcgcaaaggcgataaacgcattctttatgcttcagaaacctccgcccgcgcggtaggcggacaaattacgctgcacgcgttcgacgccggaaaattggcggaagggatgcccattcgttacctcggtattgatatcggccagatccagacgctggaattgatcaccgcacgtaatgaagtgcaggcaaaagccgtactttatccggagtatgtacagacatttgcccgcgccgggacacgtttttccgttatcacgccacaaatttccgcggcgggcgtcgagcatctggatacgattctccagccctatattaacgttgagccaggacgcggcgcggcacggcgcgactttgaactgcaggaagccacgattaccgactcacgctatctggatgggttaagcatcgtcgtggaggcgccagaagcaggctcgcttaatattggtacacccgtcctgttccgcggtatcgaagtgggaaccgtcaccggaatgtccctggggtcgctctccgatcgggtgatgatcaccttgcgtatcagtaagcgttaccaatatctggtgcggaataactccgtattctggcttgcctccggctatagtctcgactttggtctgacaggcggcgtggtgaaaacggggacatttaatcagttcatccgtggcggtatcgccttcgctactccaccaggtacgccgctggcgccaaaagcgcaagccggtaagcatttcctgttacaagagagcgaaccgaaagagtggcgtgaatggggcaccgctctgccacgttaaacaccaggctccggcgtactcgcgccggagcgttttatgctacactgcgcgcctgtttttttgccggcgatacacctgtggctcaacacgctgtctattttcctgacgcttttctgacgcaaatgcgtgaagcaatgccttccacgctctcttttgatgaatttatttcggcctgccaacgcccgttgcgccgcagtatacgcatcaatacgcttaaaatatccgtggctgatttccttgccctaatcgcgccctacggctggtcgctcacgccaattccgtggtgtcatgaaggattctggatcgagcgcgatgatgaagaggcattgccgcttggcagtaccgctgagcatttaagcggcctgttttacattcaggaggccagttcgatgctgccggtcgcggccctgttcgccgatgataatcatccgcagcgggtcatggatatggcagcggcgcctggctccaaaaccacgcagatcgctgcccgcatggggaaccgcggcgccattctggccaacgaattttcggccagccgcgtcaaagttctgcacgctaatatcagccgatgtggaatcgccaataccgcactgacgcatttcgatggccgcgtatttggcgctgcgttaccggagatgtttgacgctatcctgctggatgcgccctgctctggcgaaggcgtagtacgtaaagatcctgatgcgctaaaaaactggtcgccagaaagcaatctggatatcgcggcgacacagcgggaactgctcgacagcgcttttcatgctttacgacccggcggcacgctggtctactccacctgcacgttaaatcgccaggaaaacgaagcggtctgcctctggctgaaagagacctacgccgacgccgttgaatttttgccgctgggtgatctgtttcctgacgctgaccgcgccctcaccccggaaggcttcctgcacgtcttcccgcaaatttacgactgcgaaggattcttcgtcgcacgtctgcgtaaaatgtcatcccttccagccatgcccgcgccggggtataaagtgggggcgtttccttttacccccctcaaaggccgcgaagcattacacgttacccaggcggccaacgccgtcggactgttatgggatgaaaatctccatctttggcagcgtgaaaaagaggtctggctgttcccggcagagattgaatcactgatcggaaaagtccgtttttcccggctcggcattaagctggccgaaagtcataataaaggctatcgctggcaacatgaggcgacgatagcccttgcctgcccgactcatgctcacgcgttcgaactttctgtgcaagaggcggaggagtggtatcgcggtcgggatatttatccgcaaacaccccctgccgctgatgatgtcctggtgacgttccagcatcagccacttggtctggcaaaacgtatcggcgccagaataaagaacagttacccgcgtgaactggtacgtgatggcaaactctttactggtaatagttaaaaggcgcacaaaaaaaccgcactttttgactggcgcttttgcctacgttgactacgctgaaaaatggacggctaaactggtcgtaccacaattagcgtattaacggagagcacgatgatgaaaaccagtgtgcgcattggcgcttttgaaatcgacgatgccgaattacatggcgaatcgccgggggagcgaacgttaacaatcccctgtaaatccgatccggatttatgtatgcaactggacgcctgggatgccgaaaccagcgttcccgccattctcaacggggaacattccgttttgttccgtactcattacgatcctaaatctgatgcctgggtcatgcgtcttgcctgactcaaaaagaacccgtcgccaggcgggttatttattcttccttttctcatttcccccctgcgctaacctctcctacactatcgtgtaaagtagttaacattgaggatgtaatgttcgcgctggtactttttgtatgttacctggatggaggatgcgaggatattgtcgtggacatctacgataccgagcagcattgtctttattcgatggacgatcaacggattcgccatggcggctgttttccggtagaggattttatcgacggcttctggcgacctgcgcagcaatatagcgatttttaaccctggtcgctgataccgctattgtatccgcgctaacgtcaattgcccgccaaataccgcgcccgtatcaatatagtgtacgttggcaaaatccatgcgccgacgcaacggcgtatggccaaaccaaaaatgatcggctccgctaatcccgccgcgcttatttatgagccgttcgcggctccagagaacctgatgtaagtcgacctttttttgccattgataggttgacgcgggataatctgcatgagcgatcacatgcgtgctatggcggcaacgaacttccagtatccagggcagccgctgacaaagaataaaaagcgcttcagcttgcgcagcgtgttcagccgtcaggcgggtaaaccagtcgccaccattcatcaaccacagcgtcgactgcgatgaggcccgcgcatccagcgccatttgttcatgattgccgcgaaccgccgtcatccaggactcacgcagtaaagccaggcagcccaggctgtccgggcctctatcaatgagatcgcccacagaaactaacaagtcttgttgcggatcaaatcgacactcacgtaaccttttcattaacattgaaaaacagccgtgaatatcgccaaccacccagacatgccgccaattctttgcctctattcgctgataaatctcttcaggccgcatcatgtttttcctgtcgttcattatccaggacagatataaaaagatagcgtgtgcagatttttttgcttagtaagcgtgcgctgttgtaaatagcgaatttcaccattagcgagtaaatgctttgttatcatcgcaataaaatataactggctgcgccaggggagggttatcccctggcgcagcgagctactcactatcgcctgttcaccttcaatactcttcctccttaaaaacatatcggaaacataaaccacatcgcctcagcacacgatatagcacactctttagcggagtgatcctcaaggcaaaccagcgccaatgcaggtgtcgttaccgtggcgaccatcgcccccacaaacaggcgcagcacaattttttttaaaggcggcataacctctcctgacagttaacagaccattaatccttatcgagacatcatccgtgcgcgggtatcatagacttaacaacacgcagcgttacaaaaaaagctgtctggttgtgcaggtatttagagtaataacaattattttaagttttaaggttatccatttgatttttatattaaaataaagatgacgacgttttgttaaaagcgtcgccataaaaacgaatatatagtttcagaaaatctgctattaattcatatggttaatagcagtattgtatttactaccatcaggaggcattctgaagatacttattcgcaatattttctatagttaactgaaattgttgtggcgttggcatcgtccccttattaaacagcggcgtaacctctttcataacgattttctcagcatacgctttaaaagatacctgctgattatgatttataaacatatgcggatatttaatactcgcggaagcaatgagggggacgacaaaaggattcgcccctgccccacctggagtaaatacgccattttttatctccccaggtagccccgcattctgcgcagcctctcctatctctttcaaaaagggggtaatactgacccctttactgatgagtaatttacaacattgatctttattattactgtacacggctgataatatggcttcgcatgtctgacgagcataggccggatctttactcgcattacctttgatatccagactattgagcttttgcagcataaaatctttaacagttttactggttaataccgccctaccctcagaagcgttcccacgatgaaaatgggtagtcggtatgtctgtttgttgatgcaggctaaaacgatctgacagactcgtcgacaggctgataaagctatttctaacggcagtaatactttttgcaaaaatgtccttctccgttgttttttcttttactggttcaacgtcacttctatggattctgtagtgctgggtggatagtgttatgttagtcacggtagttctccttttagataactatgcatagctacactttgtttatatttcttgctttcaaaaaatagccaccttctccacaaccatttttactcattgatatttataaattttattttcctgatggattttgttcttctgtcacttagcctgttttttttcggcgcaaggtgatcgacttttatcgaggaacatttttatcgggacaatcctgaacaggtaaaacatcacttcaattcaactactgcgtcacataaaacattcatgaatattattatttatgctgatgttgttacgattttgcccccattcgcaggctggctaccaattatcctgccagcgagttagccgctttttcaaaacctataaagtcgccacgccaaacctctccgtcactgtaatccttatctaaacatcaattaattaactgatttttatatattatgacttttcatgacgttcagaaaaactacaaatgaaatggattgacgcatctattagtggtcaaaaaaacgcgctacgagaaataatcagtaacaattgcaacactattccaatcataacgtaaactatatgataccaggtgattattattgcttttaggtaacatatctgtatggctgcttttaagcaacaatactctaacacaacatataacattataacttacaataggttaacaaatggaattacagcttatgcttaaccactttttcgagcgcgtcagaaaggatgcaaatttcaacgcatttctaatcgatctggaatataataatatcgcttattacatctattttgttgctaccggcaatgtgaaaattatcactcatgcaggccacttcatttctattaaaagcaatagaaagctgattaaagtcaattcaacaccgaatacgcaattaataaaattgatttcagctaaacacttttcgggggagcattcctatgaaaaatactgtactgatctggcaacggcaggcgtttttaaatggattgttgaattaaaccaaaaaactcgacaatactggtcgaaagacaaccaattattatatatagaaaatgtggtcatgccgctttaacaagccagggtaataatagcgtcagtcgtgacatccggcgtgttacgactgcgggttatccaatttagagaccataatgagagtctgactgcgagagttaccctgtgcagtccgaccgacgcagcaacgtttgacacgattctcgacaacagcatctcctggtgcaggagaaatgatattcaaagcgatatcgactaaaagctcaaaatatttgccttctatttatattctatctaattaataccctccaggaagtgtggcataattgcagaatctgtcaggattccgggagcataccggagcgtaatcgaaaaaacatctggagatgtatgagcaaggatgaaatcagttatcaaattctttaccggtactctctggaaaagctatacagtactcttgccagaagagtagataacgtgctgtcattcgccctcgtttttctcggggtcggcgtcaccataaacgtcgggagtccctttattctggggccaggcattgtgggtatcgccatactaaaaagagtactccgcttcggcacgcgatcagcacaggccgaccggcagtcccgcgcctggctgaaactttttaatactcagcaccgctttccttcagataaaacactgttccttgccttcacatcgcttgagcaagacgcgagtgaagtatggtccatgcttattggtcctgccatcgtcatgactgagaccgccctcggaaaaacgcccattgagccattgacggcgggtgaaaaactctgtgcatttttgagcggcgcgacgaaatcccagctagcagatcgcaattgaactgtcttctaaacgcctgcgccataccacagagatttagtataaaattaattaatggagtactaacgctgtcagcaggtttctctgagtgaaagattcgtattatacgcacagcccagtttacagtttatataacagcgctatatgtttttgtatccgtaccatgccgcctacaagcggctgtctgagtacctctagccgtgccagggggtattagctcaaatgtgagctgacatatctatggcacagcgccaaacctaatctgactgtccgccctgtgccagaagcggacgctgatcatggtgtgtacaggccaacaatacgatatattttaaagctacctgattacagctttcataaagctatgggtattcaaatgcagcaaagctataaaccgggcttaattaaataatgcctttgcgaacctactttaggaaagtccggtagcgacatttgaagtatatacccctgtttttcataaaaagggagagcctggaagctaaaggtatctacaagtccatgaacacagcctttccgcaaaccttctttttcggccatcgccataagtttgctccccagaccgcagttccttgcagattcacttacccaaagatagtcgatgcagagccacggaccttttctgtcagcaattaatccgcctaccatttcgccgctttcgtttctgcagtagaccccaagctgcccatttttactaaaatcgacgaactgagcattgtagcttcttaatccggttaatagttcttctttatcaaattcagtaacttgatgtgtgatttgaatgtccatacatgcccaattgaacaagtttgtatttggaatataacgttataaataagttaattaaatgtatcaatagaaagtttgtttttactcctgggggcaggtcacgtccgctactcgcttaaagcaaactgtcagttggagtctgagctggtacaattaatgtgccactggttagaaatcagtaatacgattttatcaggctggtgctctggcctgtcaggatttgaggtatccacccggtttaccagccccctgtatttggcaccagtggaacccacttcccgatccaggatatccagtacccaccaccgaacctctttccccaaaagacatgagcaacctcaagcgccttgtctggatgataaccacggtatgaagtttgataacacgtggaatcagggcgtatggttcgctctccgttcagcaactggacgcccttctccccagcctttcagcgttgaagatttgccagcgctgggtgaagagtataggcgaattatgaaaatcatttctgccgtttatacttcgaaaaagacgttatcaaaaaggtggttcgcaagcgcggagttattaaacctttacttaacgaaatacggtttaagttgcttgaattgcagcagaaagaaaacgacggcttgctgatgctggacaaattaagcaagcatggcatcaatggactgatacgccgtcaataaaaggaagggtgcatggacgatcccgtcacatcaccaatcacaacagaagagcacaaaacaacatttcacagtgtaaaggataaaacacgatgccattttcaatcaaaaacatatgttcaggtccaaaaggacattgcccagaaatctccagccctatacaggacaagccagtaccgaggaattgcacactgacctcaacaacatgcgatatacagagctatacagtattcagcagatggtcctgcagttatgaaatgcgcccacccggtgcagaagaaagaaccccacgactaaaattctcagcaacggagctctcatggctatctaaaacaatagaaacagagaggcgcaacacaaaagaatgagcctgtcagtaattctgtgtaactgcccagttattaaaggtgatcgctcaggcggtcaccgaactcgataataaaacggctcatcgccagccgccagttctggatcggcatactccattttttgacgcatccttgatcgccagataaataacttttcgtactgagtcatccgtcgggaacaccttgcgtttcttaatcgcggcacggatcacgcagttcagggattagattgcgtttgtggtgtagatggccttgcggatatccggcggataactgaagagcgtattgaggttttcccagtgcgcacgccagcttttgctgatttgcggatatttatcgtcccgggctttcgcgaacgcatccatcgccatcagtgccgcctcttcggtcggagcctgaggccgctggtggcgactttgtagcctttccaggctacgtatttcagactgttacgcaccatatggataatgcacagctggatatggggctgcgggaagacgctgtttatcgcatccgggaaacccttcagaccatccacacaggcaatcaggatgtcctgaacgccccgggttttcagctccgtcagcacgcttagccagaacttttcgccttcattttcggccagccacatacccagtaactctttctggccttcggtgttgatacccagtgccaggaagacggctttgttgattacgctgccattctgacggactttgacgacaatgcagtccatataaacaatggggtacagcgcatccggttgccggttttgcctctcagtgacctgctcttttacggcgtcggtgactttagatatcagcgagggtgacacattggcgtcgtacatctctttgaaggtggcgacgatttcgcgggtagtcatgcctttggcgtagagggataaaatttggctgtccatctgcgtaatgcgcgtctggtgcttcttaagcagctgtggttcgaaggtgttttcacggtcacgcggtgtgttgagttctatctcgccgtcatcgcacaacaccgttttggacgagtagccattacgggtgtttgagcctgttttgggcgcatttttctcatacccggggtggtcagccagctccgcattgagcaccgtttcgacggttaatttcgccagcatacgggaaaacgaattgaggtcggcttcggttttaaggcctttagccagttcaaccgcaagggctttgagtttcttttcgtccataattgcctgtctccgttactggagtgaacatatcaaagacaggcaattacacaattttacttacagtctcagttcagtcacattattgatgagcgactgtacgttaagcaaatcaagaccgggatgaaaatcgctctgccactttcgctcaaccttccttccatgggtttacgcctcagtacggtgattgagcgttgccgcctggtaagccgtagcgaataccttatcagcgctggcatacgcaaaaacagcccgaacgggagtattcatcctaatagcctgactaaaaaatttgttgcggcacgaaaattgaccggaataaatttcagtgaaaacccaccgccgtttcacgagatccgcagcttatccggacgactgtataaagacgcttacggcgaagggtttgctcagaaactcctgggacatacttcagagaacaccacgaaactctatctcgatgaacgcgataataaagcttacgtgatgctctgattttgctgtaaaagaaatgttaaactggatttggatctgatataacgaaaaagcccggaatacagaaattctggaaaatttcggaaatttcggaaatttcggattattgatcataagcaactgatttataagaaaaaaagagaccgaatacgattcccgcttacggcaaccattgatatttctctttaaattcataatgttacatattaattaagtgattttaacgattggaatatgttatttttgattctaatagattcaattagttatcactttttacgttttaattcggacatatttcgggccattttgcgtataaatcccccgaccaaacaaattaactgcccaatacatcactcccctcttccattgggggactcccgatgccaaatacccatgtagacgaaggcttaatagtgatgccaacaaaagcgatcgcgaaaagttgaacaggtggctagtttcagattaaacacattggttagtcatcttgaacaagtaaaatccgccgcaactggcaaccattcaatactcgcactatcgaacgatcgccagcttgccgcagcccgttcttgcatacgatgtggctgcggttccatcacatcaggaatgtgaaaatcgggataaacctgccacttaacctgaagcaggtcttcatagcgggtggtataccgaggcgaaagcatttctcttaaggtcgccatataaaaacattctattacaacgagttatctcctcctgcctccgccccggcgcaaagctatagttttttctatctccttgtgaaacaaacaattattcttgctatggcgctgattaacaatcgttcgcgggcaacgtacattcagcgagtttcagagcttcctgacggaattcagccggtgctgtttctggggcttcttactggttgatacagatcctgcctcttacttgagaatttactcatttagccgtatgtccattatgggtggataagatcatttatcatcgtaagggttgaaagcgataagttaaacttgtcctggctcaacaagggacccgactaatgatgagctcttcatcttcaaggcgttttatgccttccagcaagaatagacattaaatcgacaactgctgccaggtcttacaggcgcagtggacaatcgtgtggtaacagcctgagtcatttattatttttctcattcagcataactgcgtcttctgatagagaaatttttatctaaacatataaaaaacacagtgaagaaaacgctacttttttctagctaaaaagctaaattaatttttttacggagaggatcttatgcgcaaggtgtcgatatctatattattcatgctagtttcactgacttgggggactacatggttggccatgcgaattgccgttgaaactatccctccagtgtttgcaaccggaatgaggtttatgtttgcagcaccttttttaatcatcattgcatggttaagaaaaaaaacactgttgtttcctcccggacaacgattattccagtttgtgatatgcatcttttatttttgcattcctttctcactaatgatttatggtgaaacctatgtcaactctgggcttgccgccattatctttgcgaatatgcctgtggccgttttgatagcatcggttttgtttctaaatgaaaaagcgaaactaatgcagatcgcgggcttaactatcgcaatcactgcattgacggggatacttcttgaagaaacgaatacaagtacagagagtcactggcagggtatcactgcgcttatttctgctgtgttaatccatgccataatatatacacaatgtaagaaaagaagttgtactgtctctgttatcacatttaatgcgctcccgtgccttttagctgggttgatactttctgcgacaggatggttttttgaaagaccacaagtatcaaccttctcagtacactcaatattagctaccctgtatctcggggcttttgccggagtttttggtatcctgtgctactttgcgcttcagcaaaaggctaatgccttccaggcttcgcttgtatttcttatctttccgctgattgcggtaagtctggaagactatatttatggatatgctatttcaacacactcaatgctgcttattataccattagttatcgggatatttcttactcttgtcgccagaaatctccctgtaaccagcagatgccgggataactcatcacagaaataatcgatttataataacgcaaataattcctgatgccttactgagctccggctaatgcggggtggataagctggaatacagacccggtaatacacagcgattatattaacaagcaatgtaataaaggagttttttatgttcatgtttctgccattcttgcttgcactgagcgtggcaatgggggccataaacagaaaggataaagtcagctacattctgtgggccgttttactcatcgtcactattttatcattcattcatcatatgaccaattcgctgactttgtcattttaaggagtgtgtatgaaaacgcatcatcatccaacaacatttgttcatctgattaatcaggtgggactccttgggatatgcgttgctctggttgtagccttttattatcaactcgtcaggcatgagctgccttgtccaatttgcttattacagcgggctggcctcatcatcgccggttttggctttttatttaacctctgctttggtctacgaggtatacattacgggatggtaattattggcagtatcctgaccggagttatggcatcccggcaaatatgtttgcatatcatgcccggtgacacaggatatggttctgcattttttggattacacttttatacctggactctgattacgtcaattctgattattattgctgttgcggtaattctggcaatcagtagcatgaatgttgcatttcgttcattgaatattaatccggacctgttcagtattgtcggttgggtatttctgttactgattactgccaaccttatttcaactgtactggaatgtggcggaggggaatgtgctgctaacccggtcacatataagctactgtcgaaacaggatattgcctttctgaaaacaggcctcctgacgaggacagttctccggttatgacgcacttttaaaatgactgattggtaaatatatagcaagcacctgtcttgtagaaattggaatggttatgggctaacacggaagttacagtaacattgaaatgttgcaataacaggaatcaaacttacaaccttcgcattacgaattagtagaatcacatttaactaactgtttcaaatacacatttccgcattcacattgctcaactcaatggcacatgatgttagaaatagaatgatgcttcaccatgtttgacacaaaaatggcacaccctataaagcatccacagcacatatttgggtggcacgcaccgtggaaatactgcattaccctaacacagggaattttctgtacagcgtcgacagccccgcatcataaataatcgctacctgctgtcgcggtactcctgccctaataaggcaccctgcctgcgcccattgctccggcgtcagttttggcctacggccaccaatgtagtggcactgtagtggcacactgggtactgaagcaatggccacaactggcgcttgatgctatcagccagataaccttccagatggataacaaacatagcagctatcctgtctgtatcggaattgtaaaaccagacgttgaccatcttcatcaaggttaaaggaacaaagagctctttaaagtaactctttgttccattacgatagtttaaatatgatgttctgaatgggccttcactacatgaacaggaaaggctcaggataaccacttctcagacattaaaagcaaatgagaaaaccaagggggcctaaacctgccgccagggaacaaacctttgcacagtctgcagtgctaccaccgtcccctatgcaccccagggcgaacgctggctaggcagcagacgacaacagcagaagagttgttatgaataaaactttacgtgatttaataagagaaaacatattattaccctcatagtaagcagtattaaataagccgggatatatctgatgttcaatcagtccctcatatagggttagcaccatagcgagtcgttttcacaaaaaacacagactgttgaaactttatttatcactttgacatttgcaatacatgacacatgattagcttcagccgccattatagggaaagctccatttccatactcatttactcacttctccctgcggaaaaagaaatgcagtatagccagcgtggtgcttttgctgaaaccaggcgcgagcaacacggcaatgatgatcggcgtcagaatgagttcggaatcggcattggcaaacaaggcgcacagtcgttaatacccaccagcagttccgccaagagtgcgacaatgtcgtaagagaggccttcagccaggcaaaacagcgctacggtgcgccccggcttgctgaggaagtgaacctggggcctgaggtacaatgtaaaaacgatagcgtccagcctgtgccatcagggtctgcggcgatctcagtccggaacaatttgaaaaccagaacctcgcttaaggctgtgtccacaatacgcggacaggatcaaaactgttagtgtggctggcttacaagaatgaagtgaagttgattgatataacaaacactcctgataatgttaactggcctgttcctccgggggagcgagccagccatgatttgaaaagcacatgaaatcactttcacatgaattaatttacattggaaataaaatataatagtgcttatcatttttatttaagttaaatattttataaatggtttttatttactcacctgatggtaatgaataacgtttaatatctatagtaaaggatgctgtaaccgtaaggatagtgtgccacaatttaacaggtaacatattatgaaacacgtcaagagcgtatttttagcaatggttttaatattaccatcttcactatatcctgctcttacaatagcggcagactctcaagatcataaaaaagaagaaacaattaagccaatgcctcaaaagtggtgtaatctttggcctgctggcatacccttccctgaagattggtttaaaatgtgtagaggttattgagtataaatttaatatactagccagtaaccatatcagttatgacagacaggccttcttcatatttgctataaataaggcctgagctttcctgacaaattataaactactggctggtttctccggccagacaggctttaaagtatcaacacggtttacctgtacccggtactttctccatgccagaagagaagctttttctttattggttgcttcgtccagatccactgcatcctgtaacggcgcgattttttcagacgctatttgcaggagtctgtttttcgttccttcagcttcacgaagtctggctgcggcctccgcagcttcatcattcatccagacctgagccttactatcccattttttgtatccaccacctggtgaaactgatgtgacgttttcaggtagcggaccaagatcggagatataaacctgattgccggttgttgtgtcgtaaaccgtctcgccgcggtgatcctcctgcagactccacgtttgggtttcagcgtcaaaaacagcaatatgactggagggaatatcaggaggggctatatcagtacaatttgccgggcgacgctgtccgggggggacctgaccacatccggcccccattgcaggtaatgcaacagatgtaattttccggtcttctccggcgcttttattgtgctgaaaaattgccagtaacgcagcccgtgttgcattataaaccgcgtcggtgccgtcaataatcagcggaacgcgcatcgtcggggcgggaaccagccacggatgtttactgttacccgtttcaataacaaaggcggtgccgacgggctgttcccccaggtattcacggatgatattttgctgtacccgttcctgtaattgcgacccgaaatatgccgtaatagcagcatccacaccgccgtccataagaccaaaggtttccgcattaccgtctgcgtccacaataacgacgtgtccgtgtggaccgatatacatggtgtgctcgtgtcctccgatataaactgtatgcgcatggtcgccagcggcctgtgtccacgcaccacctcctagctgaaatgaagtgtgattggaatctccccagtatgaattgatataaccgccgaactggttagtatgattgcccgtggtattaacgccccttttcggagtcaaaccagttcttacgctcttttggagtcattttattcgggtcctgatgttcagcagcctgggaaacgggcgtttccatcagtacgcggatcacatccgtcaggagatacagcttgtttttttcattgcttcccagtgccaggggaacgcccgagaggcgactgacaaccgtctgtcgatgtaaccctgtaatagcggcaagctgactgatattgcatttgaggttcttcagttcgccgtccatttttacctctggggctgtttcttagcgcgccctcccccggaaaaacaaaatataatgaacaaaaaacatacaaaccatcatcttttaaaaataaattacattaaaacagagagttacaacatgatgatgatgcatgaaaaatcaaaaatgcgccaaatcccgcgccgctgccgccccgtggcaggccgccccgccgggagtacctttttaaaatgcgaacaattatcaacaactaccacttaatgattatttatttcattttgcgatattgattatcattttcaataacaacacacagagaacataaatgaaaaatatcatcactattatcgtagccattattatcgttttttatgcaggtatgtggtcgcagaaattcctgatggaagatgagtgccttgattcaggtggttcatacaatgaaaatggaatttgcaatattgcaggcagtcatcaggatgttccccctaagtaagcagaatgctttttaaattcgttacccacctctacagataaggaggcgaatggtcactaaaagtaaaatccattgcagaagaatttccggaaagttgttattccagcaccccgacaggttattcagacagatttcagctatatcaaaactgagtgagtacttatcagtttcatctggtgaaaaacctgttcttattcatctggttccatctgatgatatgtagtcacttttttacagcaatattacagggggagtttcaatgcctcctgtaattatttgactctctcaccgaatcatatactcgttcacacgtcattcctgcccggtagcgctcgtcagcgattccagcataatgtttagctgcttctgcaatatctccgagcatgttggcaagcattctggcgtcggcgttggttgttttgcttctgacggcagcggcaagatttgcggtgtgctttgcggcgtccaggcgggtggcaagtttttttgcttcggtacgcagctggctaacagtggcagacaggccagcagcagtggcagcagatttagcggcttgcgcttgtgcatctttcacagcctcatcacgggcaataacgcggccctgttcaataatacgggcggcggtctgggcgttgacttcctgagaggattcagcgctgtcgcgatctgcccattttttttgccagcccctgtcactccagacattaccggcgataaacgcaccagccatcagcaaaataaacaccagctgcaaccagtatcttttcagaagagcagataacagattcataccagcaccgattttgctttctcaaagcgctcccgccgatcaccgatgccgttctaccctccgttgatgatctgcgtaacacgtaccaggtcgccggaatatttcagacaccctttagtcacaaaaagccacgctgcggatcgggcggcatgacgttctagctcaagctgtcctggattcgccactagatccagtttcagtgcaacgccacatctggtgtaattctccagcccggtaatcctgatcttcgccgaacgtggtgcgaaagctttcttgccgttcatggcgttcgcgatccggactggtacgaatatgtgcctgataacaccccaacaacccatgaagaaaatgcagcaaggcttagtcaggcgggcaaatgtctgcgggatattgaggcagggagatttcagtgtgatgaagaaaaacagcaaccgacaggcgaactggcagatgaaccagcaacgcctgaagcagtggaacaggacacaactgaacatcatccggacccacagccgctggagaatgaaccacctgtaagccagacagaagcaggctaccagaaaatacgggcagaactgcacgaagcacgtaaaaacattccacccaaaaacccggttgatgttggtaaacaactggcagccgcgcgcggtgaatatgtcgaagacatcagcgacccgaacgatccgaggtgggttcataacaattacagcgcctcaaatcagggtgaaaaagaagaagtggtgccggagggaaaacaaccagcagcagagccggaggctgtcaccagaaacgcggacgggactttcgatgtatcagcgctattcctgcccccctcaaaccagaccgaaaaaacggaagccagaacagaaagagatggagaaacgccgaaagagagcaaccagcaggaaacggctggcgatacaggacaggaaattacaacggacggtggatcaggtacaacttcatagcgcaaaaccacacgccagtggcgcttattgaaaaactaaaaggaacggactcattcactgtgtccgcatggattgatcgctatgaggttttattacagcgccggaatctgtcggttaatacctacaagattcgcagtaatcaattagcgaccgtacgcgaaaaaatgggagaaataatactggcagaagtaacaacccggcacattgccaagtttcttgagtcgtggataaccgagggaaaaaacactatggcgggagcaatgagatcagttctatctgacatgttcagagaggctattgtcgaagggcatattgtgaaaaacccggtggaagcaacccggataccagagattaaggtggccagggaacgcctgcaactggaaacgtataacgccacacgagcggcagcagagcatatgcctgcatggttccctctcgcgatggatttagcgctcgttactggtcaacgtagggaggatatcgtaaatatgaaatttagtgatgtttttgacaaccgcttatacgtcactcagattaaaaccggaatgaaaatagccattcccctctccctgacacttcgggcgacggggttacgtctgggaacggtaatcgatcgctgccgacttgtaagccgcactgatttcatgatcagtgccggaatcaggaaaaatagcccgaccgggaatattcatccggatggattgacaaagacatttgtaaaagcaagaaaagcctccggtgttaacttcagcaataatccaccgacatttcacgagatccgaagtctggccgggcggctgtacaaaaacgagcacggcgaggtgttcgcccaaaaactcctgggccacacatcagagaacaccacgaaactctatctcgatgaacgcgataataaagcttacgtgatgctctgattttgttgtaaaagaaatgttaaactggatttggatgtgatataaccaaaaagaccggaatacagaaattcgaggaaatttcgaggaatttcgaggggaaacacataacccattgatttataatctaaataaaaagagaccgaatacgattcctgtattcggtccagggaaatggctcttgggagagagccgtgcgctaaaagttggcattaatgcaggctaaatcgccttgccctttaagaatagatgacgacgccaggttttccagtttgcgacgaaggtgattgaaaaaacctggcgttttgtctgttatcagagataaaaaaaccgtaagccttttcgtgaaggtttacggttttttattaaaaatcagtcagctattggatggatcacaaagcttttgcgcacgttcgataaacggcgccagactcattttctcaccgggcttcgccgggttatcgatttgaatgacggcaataggctgagcgcgcgttttaccctccgctacttgctgttcggcaatggcattcaagggatactgcaccagcgtactggggttgatcacatagagcgcctggccaggccgacaggtcaacatgacctcttcccgattaaacgcccacttgtcttttcctacttcaaaacgacttacggtaatcacctgcggcgccgccaacgctacgcccgaagtggccagcagaagcgccggaaggagtatttttttcattcgttatgccagtccatcaaaaaggttcgagggttgcaaacaggctgacgatcgccagaactatgcctccaactccccattcaatttgcgtcatcctgacaaaccataggtcagtccggggattttcctgtcgcatacgtggtacgagaacataccgattcgtcagcgcaattgctaccataagcacgaccagcgcacattttaacaaaagcaactgtccataggtggtctgccagatagcggtaaatcccgtgataaatagcgtgttgccaatgcctgtgagcaatacgcccgccacaaaaaagtgaccataacgagaaaaacgcatcatggcgctaatagcatgttgacgccagcgtccctgagccatgcgcatacaataaaccactggcaacagcccgccaaaccaggctgcggcacagagtaaatgcagagcatggttaatctgctgtaatgttcccgctacaccgtcgcgcatcgtcgcatgtccaacgcctgccagcaggataaactgagcaacggttagaataagaagccgtcgttgcatttttaccggcgcaatgactaccaccgccagcgtgaccagcgcgaggataatttgccatatccagaccgcgccaaagcgggtttgcagtaccgcgccccacaccgagacgaaaaaaacatcgggccagccgccgcccatcagtccgccctgaaccgccagcatgaaagccgcgctgataacgctccaggcggcggcatgttgttgcagatgtaaaaatcgacgcgtcattaaacgacgaattgatgcgggtgccagccaggcaccgtaaagcgcgcagccgtagaccagcatcacactagcaaaatgaataaatcggagagttatccagacgaatgtcagcatcatttatttcacgctgaaggtgtatttcccttttgttttatgtccatccaccgacacaacgtgccagtctaccgtgtaagcgccagattttaacggctgctcaagcgggataatcaactgcgttttatcctgttcatttcgctttgccgggcgcgttttgatgagctcttgctgagggccagtaatggttgcgccgctgaaccctggctcaatcccttcagaaaagttcagggtcagcgcctgtggcgaggccgtaacggcagcattcgccgctggatactgatgcgtcaggtgcgcatgtgcccaggccgctggcgtcgcaaatgtcgatgccagcagcagtaaagctaaacgtcgcgatggtgcagaagaagccatattcactattcctttttgttatacctacgttacaaagaataaccttcaacaatcaatgagtcgaggatcatcatttccatcttgccattaccgcggactcttagtaccttctggcggcaacaaaaaaggagacacgtatgaaaacaaatctggctcagcttgaacaagcggaaatggataaagtcaatgtggacctggcggcagccggggtggcatttaaagagcgctacaatatgccagttgtcgcggaggcggtcgaacgtgagcagccagagcatctacgcgcctggtttcgcgagcggctgattgcccatcgtctggcttccgtatcactatcccgactcccttacgaacccaaagttaaataaaaattatataacgttacacttccttacatgcagacgactacattataaggcgattcttaacctatgctttttagaatggctgtagagactatgaaaaggaagtcattatgtcctcctggaaaattgctgctgcgcagtatgcgcccctgaacgcctcgccggcggagcatgtcgcccatcatctggaatatattgagcttgcggctcgtcaacagtgcgaactgctggtctttccgtcactgtcgctattaggctgcgacgaaaggaataaatcgttgcccgccccgcctgacgaggcgcttttacagccgctcactcatgcggccgatacccaccatatgactatcattgtgggtatgcctgttgagcataactgccgcttcgtaaaaggcatcgctatttttgccccatggctaacgtcgccgctcatgtttcacaaaagtcatggcgcctgtattgccaggcagcgaagcgctatcaacgtggtggatgagcagccagaaggtggtgatatagatccctcatttacgttattcacaaccagtcaatgtcttaacgaacctgaactccatgcttctacctcacgcttacaacgtttttcgcataaatatgcgctggccgtactgatggccaatgcctgtggaagtagcgctctgtggaatgaaagcgggcaacttattgttcgtgccgattgcggttcgctattactgacgggcctgcgcacaacggagggttggcaaggcgatatcattccattacgctaaggtctttcggtgaggaatgaatcatgttgcggattatagacacggaaacctgcgggctgcagggcgggatcgtagagatagcctctgttgatgtcattgatggcaacattgtcaatcccatgagtcacctgatacgccccgatcgccctattacgccgcaggcgatggcgatacaccgtattaccgaagccatggtcgccgataagccgtggattgaagatgtcataccgctttattacggtagtgagtggtatgtcgctcacaatgccagtttcgacagacgcgtattacctgaattgccgggtgagtggatctgtaccatgaagttgtcgcgacgcctgtggccgggaataaaatacagcaatatggcgctctataaatcgcgcaaactaagcgtacaaacgccgccggggctgcaccatcaccgggcgctttatgattgctatatcaccgccgccttgctgattgatattatgcgaaccaccggctggaccgcggaagagatggtcaatattacgggccgtcctgcgctgttaaccactttcccgttcggtaaataccgcggtaaggcggtatctgaagtcgcaaaacgcgatccgggctatttacgctggctttttaataaccttgataatatgagcccggagcttcgcctgacgcttaaacactacctggaagatgttcaggctggcgagcaacgcagcaatggaacaccacaataacccgcgacgctcacaagccgttgcgggcgcgcgtctatgcgctatgtaaggttccctgcgccaggccgattaaaaaggcgaactccagcgcgacgccttcgtaggatttaaaccgccccgacttaccaccgtgcccggagtccatatccgtacataacagcagcagacgttggtccgtttttagctcgcgtaattttgccacccacttcgccggttcccagtattgcacctgggagtcgtgcaatcctgtcgtcaccagcaggtgcggatagtcctgcgctttgacattgtcataaggactatagcttttcatatagtcataatactcaatatcctgcgggttcccccactcttcaaactctcctgtcgttagtgggatcgactcatccagcatcgtggttaatacatcaacaaagggtacctgggcaataacgccgtggaaaagctcggggcgttcgttgatagcgacgcccattagcattccgcccgcgctcccgcccatcccataacacagcgacggcgaaccgtaacccagttttaataaggcatcgcaggcatcaagatagtcattaaaagtattccgctttttgaggaacttgccatcttcataccactgctgccccagctcaccgccgccgcgaacgtgtacgattgcgtaaacaaagccacgatccagcaagctcagtcggctgctgctgaagtcggcgtcaatactggaaccgtaagatccgtaaccgtaaaccagaagcggattttgccctttacgaaaatacttctgatgataaaccagcgataccggcacttcgacgccgtcgcgtgcggtgatccacaggtgttcgctctgataacagccagaatcaaacccaggcacttccgtctgtttaagtacccgtcgttctccggtatccatatccagttcaaacaaggtatctggcgtcgtcattgaagaatagccgtaacgcagccgggaggtctcaggttcgggattataggcaagccacgtcacgtaagccggatcgtcaaaggcgatgcctatcacttcacgggttttacggttaatttgccgcaggctggtaagcccccgttgacgctcttcgaccactaaccagtcggtaaacagggtaaacccttccagcataatatgctcgcgcggagggatcagctcttcccaggcgttttcattgcgcacgcgggtacggtacaacccaaagtttttaccgttccggttagaacgcaggtaaaacttatgttgatagtgatcgagactatattcatggtctttgcggcgcggtaaaaatgaaaacggctcggcatcggccagttccgcgtcaagtaatagcacttcgctagtggtggcgctggcaaggtgaatcaccacataatgctgcgaagtggttttatgcaggctgacataaaaggtatcgtctttctcctcatataccagttcatcttgcgatgacggagtgccaatcgtgtgccgccaaacctgatagggcagcagcgtcttcttatgcttacgcacatagtaaagggtcagggaatcattggcccagacaaattcaggcgcaacgttatccagcagttccggataccagttaccgctttcgaggttacgaaaacgcaacccatactgacgacgggataaataatcttctgccagcgccatgatggtattatccggcgtaatggcaagtccaccgagcgtataaaattcgctgtgcgcggcccgctggttcgcatcgagcaaggtttcccacacatcccactcttcgcttaacgccgattgtcgttgatagatggcatattcgcagccgggttcatagatataacggtagcgatagccatttttcacatacggagcggaaacttctctgggcgggatgcgatcgataatttcttttagaatgcggtcctgtaacgcctgctgagaggtcatgaccttccggccatactcattttcctgatgcaggtaatcaaggacttccggctgcgagcgagtgtcatctcgcagccagtaataattatcaatgcgcgtatcgccatgtacggtcatggcatagggaattcgattggcttttggcaacatgtcgttttttcttttgcgttaatatttgttatatatcacgcggcaaacacagcggcgtagcatggtagtcccggtcgctcacctcggtaagcgcctgagatgtcactgcttcgccgctatcttgcaacatgaatgacgtaaactatccatcctataagggtggcaaaagacacgcatgatgcaagcgaaacatgttacttaatggcaggttatcagcctggtagcgcctgtttttgctgctgcaagtcctgctcgataccgtcccgaacctcctgaggaatttttagcgcgtctcctaacgcattcagatagctacgttccataaagtggtcaatatcaatggcggcgcagctcaggaagtagatttccagggcttcttcttcattgcgaatgccctgtgccagacgttgtggatcaagcggctgctcaatagctttttcgataaacacacgcccttgctcttcaacacctgattctcgcagttggtgctcaatcgccgcgcgttctttggcatcaatatgcccatcgctttttgcagcaaaaaccagcgccaggatcagtcgctcagtgcgaacatccagcggcgtactttggctgccgaattgcggctccccctgatgcgcggcgcgtactttatctttgtacttattccacaatacggaacccgccaccgcgccgccgcccaccagcaaagcgccagtaccgtatttggttaataatttgcgcgaagacttattggcgaccaacagtccagccagaccgcccagcgcgccgggaaccagcagtttatttaacccctgttcaccggaaggcgatgcggaagcgcctttttgcccaagaagtgattgtaattggttcaaccagttagccatagtacccctcaaatacagaccaataatggtcaagcgtacctgaggggatgtcaggaattgtctgttccggcaaaagaagcgcaaattacgctgctagcggggcttatattccgccttgccggctttgcaatcaacgatgacctgataatgaatatcggcgcttttaccgcgaacagttagcggaactgtccatttatcattttgacccacaacgtcctgcacattaacccacgcgaccgggtcagcctgcccgacctttttttggtcgtcggcccaccgcacgatacgattttgctggtagtcgcgcttcacgcttgccgcaatcccggcggcatccagcccttcgcactgcggaaacttaaccgatttactctcggtggatgccgcaaatgccgatacgctggcggataaaaacagcaggctcaacaacgctcctcttttattcatacttttctccttagcacaatgattcaggaaaagcatggtacaaaacgccgggagcgcaagtgtgggttcaggcggcttgctttttcgttttactcgcggcgtccttttcaaccgcctgcggagaaggcaacttaccggttttgaggatagtgcttaacacctctttatgttccgccagccacagcgacaacgcttcgcgctgcccatcttccagcacgactggcgactgctcaagccaggtatcaagaagatcggcagtatcgagcattttgtcccaggcgtcggcttcctttttactggtaaatgacatcttctcctcaccctcgcgaatgactacgtatttaacttcaaccgccattttgcagccccttatttacctgtgtttatatacagtatattgcaaggcagcaagaaaagcaatttattcgaaaagacatacgcaaacgttttcgtatatactgcgcgcaggtaaataaggggacagaaatatgacgctattaggcactgcgctgcgtccggcagcaacgcgagtgatgttattaggggcaggagaattaggaaaagaggtggcgattgaatgccaacgcctggggatcgaggttatcgccgtcgatcgctatcctgatgctcccgccatgcatgtggctcaccgttcacacgtcattaatatgctggacggcgaggcgctacgtcatgtgattacagaggaaaaaccgcattatatcgtgccggaaatagaagcgatcgccaccgatacgctgcgcgagctggagggcgaagggctgaatgtcgtgccttgcgcccgtgcaacgcagctcacgatgaaccgcgaagggatccgtcgcctggccgcagaagaattaggactgccgacatcgacgtatcgctttgccgacagtgaggccagttttcatgatgcggtagccgcagtgggttttccttgcatcgtcaaaccggtcatgagctcttccggcaaaggccagagctttatccgctcggccgaacagctcgcgcaggcatgggagtatgctcaacagggcggacgcgctggcgcgggtcgcgtgattgtggaaggcgtggttaaatttgattttgaaattacgctgctcaccgttagcgccgtcgatggcgtgcatttctgcgcgccggtcggtcatcgtcagcaagatggtgactatcgcgaatcctggcagccacagcagatgagcgaactggcgctgaagcgggcgcaagagattgctcgtcatgtggtactggcgttaggcggtcatggcctgttcggcgttgaactcttcgtctgtggcgatgaagtcattttcagcgaagtctcccctcgcccgcacgataccggaatggtcacgttgatttctcaggatctctctgagtttgcgctgcatgtgcgcgcctttctgggaatgcccgtaggcgctattcgccagtatggtcccgctgcctcggccgtgattctgccgcagcttaccagtcaaaatgtgacgtttgataatgtacacgcggcggtaggagccggagtgcaggtacggctgtttggtaagcctgagatcgacggcacccgtcgtcttggtgtagcgttagcgacaggtgaaaacgttgaagaagcggtgataagagcgaaaaaggccgtcagccgcgtgacggtaaaaggctaatgcgccatcgcctgatggcgacgttagcgcatttttatcagacctgcctgatcgccactcgtaagcccgataagcaagcgccatcgggcatttaacggcttactgcttcgcgccttctaccgcttcgcgcgccagtttggtgatgcgatcgtaatcacccgcttccagcgcgtcggccggcaccagccaggaaccgccgatgcacaacacgcttttcagcgccagatagtcacgatagtttgccggagagatgccgccagttgggcagaaacgtacctgagagaacggaccggcaatcgcctgcaacgctttagtgccgccattcgcttccgccgggaagaatttgaactctttcagaccatagtccatgcccaacatcagttcagaaacggtgctaataccgggaatcaatgggatagtgcctgccgtcgcggctttcagcagtggctcagtcagtcccgggctaatcgcaaattgcgcgcccgcttccgtcacctccgccaactgctgcggattgagaacggttccggcgccgacaatcgcttccggcacttctttagcgatagcgcgaatagcatccatcgcgcaggccgtacgtaaagtcacttccagaacgcgaacgcccccggccaccagcgctttagccatcggcaccgcgtgctccagtttattgactacaatgaccgggacaaccgggccggtggtcaggattgcttctgcacttgttttccagtttttcatcggaattcttctctcgcctgattactagtgtgtcatcttaaaaagtgatacaggttgcgccctgctccgcacccgacagcttttcgcgcagcgcgccaaacaactcacgccccgttccgacgcgcgacgcgctcaggtccggaatatgaggctgacgagcggcaagttccgcctcgtcgaccagcagagttaactcacctgtctgcccattcacgcgaatgatgtcgccatcgcgcacttttgccagtaagccgccatcgtaggcttccggcgttacgtggatagctgaaggcactttacccgaagcgcctgaaagtcgtccatcagtaactaacgcgattttgaaacggcggtccaataatacaccaagtggcggcatgagtttatgtaattctggcattccattcgcttttggtccctgatgacgcacgacaacgacacaatcccggtcaagcaggcccgcgtcaaacgcaggcagcacatcatgctgactttcaaataccatggcaggcgcttcaatgatctggttttcaaccggtaccgcagacgtcttcattactgcgcgccccagattaccgcttagcaccttagtaccgccgtgaggagagaacggcttatcaaaagaggcaatgacatcgttatccagtgacctttccgcgccttcacgccagtccagctcgccgttgttgagccagggctccagcgtatagcgtttcaggccgaagcctgcgacagtattaacgtcttcgtgcagcaatccggcattgagcagctcacgcatcaataccggtacgccgcccgccgcctggaagtggttaatgtccgccggaccgttcggatacagacgcgccatcaacggaaccacttccgacaaatccgagaagtcatcccagttgatcagaatgcccgccgcgcgcgccattgcaaccagatgcatggtgtggttggtggagccgccggtagccagcagcgcgacaatgccgttcaccacgactttttcgtcgatcattttaccgagcggcatccacgtattgccgttgccggtaagacgtgttacctgacgtgcggcagcggcagtcaatgcctcgcgcagcggcgcatccggatgcacaaacgaagaacccggcaactgcattcccataaactccaccaccatctggttggtgttggcggtgccgtaaaatgtacaggtgcccggcgcatggtaagaggcggcttccgactccagcagcgccattctgtctacttttccttccgcatatagctgacgaatacggactttttctttattcggcaggccgctcgccatcgggcctgacggaacaaaaatcgcgggtaaatgaccaaaagagagcgcggccatcgccagccccggaacgattttgtcgcatacgccgaggaataacgcgccgtcaaacatattgtgagagaggcctactgctgccgacatcgctatcacttcgcggctgagtaatgacaactccatgccatcctgcccttgcgtaacgccatcgcacattgccggtacgccgcctgcgacctgacctaccgcattcacggaatgcagggcctgacgaataatctgcggataatgttcatacggttgatgcgcagagagcatgtcattgtaggaggtaataatggcgatattattgcgcaacatacttttcagcgaggctttgtcctctggctgacaggcagcgaagccatgcgccaggttgccgcaggccagttgagatcggtggaccgtggcggttttcgcctgctcaatgcgggcaagataggcttctcgggtctgctgcgagcgttcgacaatacgctgtgttacgcgtaacaaattaggattcatagaggctcctgaaatttatctgtccggctaccgggtttaccatgcgtttcatcaatgtggaaagacagtgaaatacatgatgtccggtgataatggggcaaaatcgtttcaggcagtgtaataaaaaaagcctcgcaggtgaatccacacgaggcttaaaagtgcaaaaatgattctacaatctgtgttagatcatgttaccggtaaaataccacctaagagtgagtggcaaatttactcaaactcattccacgaacgaccgtcacgggtaatcatcgccacggacgctaccggtccccaggtgcccgcctgatacggcttcggcgcgtcgttgtccatcgcccatgcttcggtaatggagtccacccacttccaggcttcttccacttcgtcacggcggacaaacagcgcctgaatgccacgcatcgtttccagcagcaggcgttcataggcatccgccaggtgcgtctgattaaaggtctcggagtagctcagatcaagcttcgtgatctgcagattatgcttatgatccagccccggtactttgttaagcacctgaatatctacgccttcatccggctgcaggcgaatcgtcaatttgttctgcggcaggtcttgccaggactctttaaagaggttcagttcaggcgtcttgaaataaaccacgacttcagagcacttggttggcagacgcttgccggtgcgcagatagaatggcacgcccgcccaacgccagttatcgatgtcgacgcggatcgcgacgaatgtttcggtgttgctgcttttattcgcgccctcttcttccagatagcccggcaccttttgcccctgcgcaaagcccgcggtgtattgaccacgaaccgttttttcacgcacgttggagcgatcaatccggcgcagcgatttcaacactttgactttttcatcgcgaatactgtcggcgctcaggtcagacggcggtgacatggcaatcatgcagagaatttgcagcaagtggttctggatcatatcgcgcatctgaccggcctggtcaaagtatccccagcgcccttcaatccccacctcttccgctacggtaatctcaacgtgatcgatagtgcggttatcccagttattaacgaataacgagttggcaaaacgcagcgccagcaggttgagaaccgtttctttacccagatagtggtcgatacgatatacctggcactcttcaaagtattcgccgacccgatcgttaatctcacgcgaggtcgccagcgaagtacccaacggtttttccatcacgacgcgcgccggtttggcgttgagtttagcctctcctaaccctttgcaaatagcgccaaaggtgctgggcggcatcgcaaaatagttaatggtggtgcggtttttttgatccagcatatcgcccaggcgactaaacgcaggcgtatcgttaacgtcaagattacaaaaatccagacggccgctcagcgtatcccacaagccttcatcaattttttccttcatgaaggtttccagcgcttcacgcacaacgtgggtataggcttctttatcccagtccgcgcgccccaccccaatgatacgggtatccggatggatctggccggctttctcaagctgatacagggaaggcagcaatttccggcgcgccaggtcgcctttcgcgccgaaaatgaccaggtcacatgcctgggctgtttgcgttaccgccatgtcattctccttagttaatctcctggtactttagccaggatatcgttgtaattttattacacagcactgtactgcttttacgagattacggaaaccgtaaacgccttttcatggatgaaccggcgtttgattggcaatataatcggcaaaacgcctaataaaattgtcgcttttccacacaagctggaacttaaaatccgacgtcggtcatgtaatgaaaaaaaacgacaccttttttagccattttgcccccttcggcagtcgccaggagtaatatctaacaaaacgcgctcggtttcgcgcatcattgaaatcgctaatacccatgagccttgctaatcatgaatatgctggaaaaagtccagtctcaactggaacatttaagcaaatctgaacgaaaagtcgccgatgttattctggccgccccaggcagatcgattcacttaagcattgccatgctggcccaggaagctaacgttagcgagccaacggtgaaccgtttctgtcgcagcatgaatacccgcggctttcctgattttaaactgcatctggcgcaaagtctggcaaatggcaccccctatgttaatcgcaatgtggatgaagatgacagcgtcgaggcctatacagggaaaatcttcgagtccgctatggccagtctcgaccatgttcgccagtcgctggataaatcggccgtcaaccgcgccgtcgatttactgacccaggcaaaaaaaatcgccttttttggtcttggttcctccgccgcggtcgcgcatgacgccatgaataagttttttcgcttcaatgtaccggtgatttactccgacgatatcgtgctgcaacggatgagctgtatgaattgtagcgatgatgacgtcgtcgtgctcatttcgcatactggcagaaccaagagcctggtggaactggcgcagttggcgcgggaaaacgatgcgatggtgatcgccctgacctccgctggaacgccgctggcgcgcgaagccacgctggccattaccctcgacgtaccggaagatacagacatttatatgcccatggtctctcgacttgctcagctgaccgtgatagatgtgctggcaacgggatttactttgcgtcgcggggcaaaattcagagataacttgaagcgtgtcaaggaagcgctcaaggaatcgcgttttgataaagaattactcatcaagagtgatgaccgctaaaagcaataacaatgttctacccttttcgtcatccggggacgttcattttataccgttaaggtttcagaacgaccggatcaatgttcacgcaacaccaagttgttttagtcaacggagtattacatgtccagaaggcttcgcagaaccaaaatcgttaccacgttaggcccggcaactgaccgcgataacaaccttgagaaggttatcgccgcgggcgcaaacgtagtacgtatgaacttctctcacggctcgccggaagatcataaaatgcgtgctgataaagtccgtgagattgccgccaaactggggcgtcatgtggctattttaggcgacctgcaagggccaaaaattcgcgtttccacttttaaagaaggcaaagtgttcctcaacatcggggacaaatttctgttagacgctaacctgggtaaaggcgaaggcgacaaagaaaaagtcggcattgattacaaagggttgccggcagacgtcgttcctggcgatatcctgctgcttgacgatggtcgagtgcagttgaaagtgcttgaagtccagggcatgaaagtctttaccgaggtcaccgtcggcggcccgctgtctaacaataaaggcattaacaagctcggcggcgggctttctgctgaagcgctgaccgaaaaagacaaagccgatattcaaaccgctgcgctgataggtgttgactatctggccgtctccttcccgcgctgcggcgaagatctgaactatgcacgccgcctggcgcgcgacgccggctgcgacgcgaaaattgtggctaaggtcgaacgcgccgaagcggtatgcgaccaaaacgccatggacgatatcattctggcctctgacgttgtgatggtcgcacgtggcgatctgggcgttgaaatcggcgatccggagctggttggtatccagaaagcgctgattcgccgtgcgcgtcagctaaaccgcgcagtcatcaccgcaacgcaaatgatggagtcgatgatcaccaacccgatgccgacccgtgcggaagtgatggacgtggcgaacgccgtcctggatggcacggatgcggttatgctgtctgccgaaaccgcagccggtcagtatccttctgaaaccgttgccgcaatggcgcgcgtctgcctgggcgcagaaaaaatccccagcatcaatgtgtctaaacaccgtctcgacgtgcagttcgacaacgttgaagaagccattgccatgtctgcgatgtatgcggcaaaccatctgaaaggcgttaccgcgatcatcaccatgacggaatccggtcgtaccgcgctaatgacttcccgtatcagctccggcctgccgattttcgccatgtcgcgccatgaacgcacgctgaacctgaccgcgctctatcgcggagtaacgccggtgcattttgatagcgcggctgatggcgttgtcgcggcacatgaagctgttaatctgctgcgcgataaagggtatctggtttccggcgacctggttatcgtgacccagggcgatgtcatgagcaccgtcggttcaaccaataccacgcgtattttgaccgttgagtaaaactcccccacgcctgttcatcaggtagtacagggtttgtcagcataaagcctctcttacgagaggctttatttatttgatgggataaagatctttacgcttatacggctgaatctcgcctggcttgcgggttttgagcagcttcaggatccaggtgtactgttccggatgcgggccgacaaaaatttcgacctcttcgttcatccgtctggcgatagtgtggtcgtcagccgtgagcagatcgtccattggcgggcgaatctggatagtcaggcgatgcgttttaccattatacaccgggaaaagcggtatcacgcgtgcgcggcacactttcatcagccgaccaattgcaggcagcgtcgctttgtatgtcgcaaagaaatcaacgaattcactatgctccgggccgtgatcctggtccggcaggtagtaaccccagtagccctgacgaacagactgaataaagggtttaatcccgtcattacgcgcatgcaaacgtccgccgaaacgccgacgcactgtgttccagatatagtcaaaaaccggattaccctgattatgaaacatcgccgccattttttgcccctgagaggccatcagcatggctggaatgtcgacgccccagccatgcggtacgagaaaaatgactttttcgtcgttacgacgcatctcctcgataatctccagaccttcccagtcaacacgctgttgaatttttttcggaccgcgcatcgccaactcagccatcatcgccattgcctgtggcgcggtggcgaacatctcatcgacaatcgcttcgcgctcagcttcgctacgctgcggaaagcacaacgacagattaattagcgcccggcgacgagaactcttccccagccgtccggcaaaacgccccagcgtcgccagcaaagggtcgcggaatgatgccggtgttaatgcgatccccgccattgccgccgcgcccaaccaggcgccccaatactgtggatagcgaaaggatttttcgaattcagggatatactcactattattttttttggtttccatgcttttccagggtctgctgacgcgaaaaggaattgtgaatagtgtagcgacgtctgcgtctcacacaaaacaaaaaagccggcacacatcgcgtaccggctctgtcagcgcatttgttaatcgaagcgcagttgcggcagaacctctttcacctgtgccaggtattcacgacgatctgaccccgtcagaccttccgtgcgcggcaattttgctgtcagagggttaacggcttgctggttgatccatacctcataatgcagatgcggccctgtggaacgcccggtgttaccagaaagcgcaatacgatcgccacgtttcactttttgccccggtttcaccagcagcttacgcaagtgcatgtaacgtgtggtgtaggtgcgtccatgacgaatcgcaatgtagtaaccggcagcgccgctacgtttagcgaccacgacctcgccatcccccaccgacagcaccggcgtaccctgcggcatcgcaaagtcaacgccacgatgcggcgcaacgcgtccggtaaccgggttcagacgacgcggattgaagttggaggagatgcggaactgtttagcggtcgggaagcgtaaaaagcctttcgccagaccaaccccattacggtcatagaatttaccgtcagcggcgcgaatggcgtagtaatctttaccatcggaacgcatccgcacgcccaacaactgactctgttcacgcttgccatccagcatctcgcgcgacatcagaaccgaaaattcatcgccctttttcagcttgcgaaaatccatctgccactgcatggcttttatcactgcgctgatttcgctgctggttaaaccggcctctttcgcgctggcgacaaagctaccccctaccgtacctttcagcagactgttgacccagtccccctgctgcatttcactgctcattttaaaaccgttggcagtgcgatcgtaggtacgcgtttcacggcgggagacttcccatgtcagacgctgtaaatcgccatcagcggtcagtgtccaggaaagctgttggccaattttcagattgcgcagctccttatcagaagcggcaagtcggctaatatcgctcatatcgatgccgtactgattcagaatgctgcttaacgtatcgcctgtggagacgacgtattcatggacgccgacttcgcctgcggttttatcgtccagctcatcctgaggaatagcttcatcttcctgcgcggcctgatcgatgggttcgctggcctccggtaagagggaacgaatctcgcttttctccagttcaatagttttaacgattggcgcggattctgggtggtaaacatagggccgccatacggcgacggccagtgtcagaacggtaagtgaccccagcataacgcggtggggtcggggcagattattaaatgccagggcgacagagcgggctatctgttgcacgtattcacttcctcgttaatctcctttcaggcagctcgcatactggttggctaattggcttaaaaacgctgaatagcttgttttacccagtttaatgttcgtcccgagggggtccagtgttcccattcgaacggatgtccctctcgccacggcttccacgaccgctggcctgaattgtggctcagcaaaaacgcaggttgctttttgctcaaccaactgtgttcttatttcatgtaaacgctgcgcgccaggttgtatctcagggttcacggtaaagtgaccgagcggggtgagtccgtagtgtttttcgtagtaaccgtaggcgtcatgaaaaacgaaataccctttccccttgagcggcgcgagctcgttaccgacctgtttatcggttgcggctaattgtgcctcaaaatccttcaggttggcgtcgagtttggctcgactttgcggcataagttccactaatttttcatggattgcaaccgctgtagcccgcgctatctctggggagagccaaagatgcatgttatattcgccgtgatggtgatgtacgtcacctttttcctcatcggcgcccgtatgcgcatgttcatcctcatcatcatccgcgcccttcatgagtaacggttttacatcggcaagttgcgcaatggtaacctgcttattatcagggatattcctgaccgacttctccataaaggcttccatttccgggccaacccagacgactaagtccgcgccctgtaagcgttttacgtctgatggacgcaatgaataatcatgctcggaagccccatccggaagtaatacttgcgtatccgtaacgccatcagcaatggcggaagcgatgaacccaagcggtttaagcgaagcgacaacggcggcgtcggcagcctgggttgcactcccccaaagcgcggcggataatgctgcgaaaagaagcgtatttttctgtaacataatgcgactaatcatcgtaatgaatgtgtgaaatgtgatattataacattctatcacttctgcaagcctaaaattaacatgacaagtttagtttcactggaaaacgtctcggtctcatttggtcaacgccgcgtcctctctgacgtgtcgcttgaattgagccccggaaaaattttaacgcttctcggccctaacggcgcggggaagtcaacgcttgtacgcgtggttttaggactggtagcccctgatgaaggggtgatcaagcacaacgggcaactccgtatcggctatgtcccgcaaaagctctatctcgataccacgcttccgctgacggtaaaccgatttttacgtttacgtcccggcacgcaaaaaacggatattctcccggcgcttaaacgcgttcaggccggacatttgattgacgcgcccatgcaaaaactctccggcggtgagacacagcgcgtactgctggcgcgtgctctgcttaacaggcctcagttgctggtacttgatgagccgacgcaaggcgtggatgtcaacggccaggtcgcgttatacgaccttatcgatcagctgcgtcgcgaactcgattgcgccgtgctgatggtgtcacatgacctacatctggtcatggcaaagacggatgaagtgttatgcctgaaccatcatatttgctgttccggcgcgccggaagtggtgtctatgcatccggaatttatctctatgtttggcccgcgaggcgcggagcaattagggatttatcgccatcatcataatcatcgccacgatttacagggtcgtattgtactgcgccggggaaatggtcactcatgattgaattattactgcccggctggctggccgggatgatgctggcctgcgccgctggtcctttgggctcatttgtggtctggcgtcggatgtcctattttggcgatacgctggctcacgcgtcgcttctgggcgtggcgtttggcctgttgctggacgttaaccccttttatgcggtaatcgccgttacgctgctgctggccgccggtctggtatggctggagaaacgccctcacctcgcgattgataccttactgggcattatggcgcacagcgccttatctttaggactggtcgtggtcagcctgatgtccaacgtccgcgttgatttaatggcttatctgtttggcgatttgctggccgtcacgccggaagatcttatctcgatcgctattggggtcgttattgtgctggccattctcttctggcagtggcgcaacttgctgtcaatgactatcagtccggatcttgcctttgtcgatggcgtgaagttacagcgcgtgaagctgctattgatgctggtaacggcgttaactattggcgtggcgatgaagtttgtcggagcgctgatcattacgtcgctgctgattatccccgccgcaaccgcgcgtcgctttgcccgtacgccggagcagatggcgggcgtcgccgttggtgtaggtatgatagcggttacaggtggactgaccttctcagccttttatgataccccggcagggccatccgtagtgctgtgtgccgcgctgctgtttatcttcagtatgatgaaaaagcaggcaagctaagcgtgtgttgcccggtggcgctgcgcttaccgggcctacaaaatcgcccaggtctgatgagcgcagcgacttcaggcgctaaggcatctctggcggcgtgatcccgaaatggttccaggcgcgcaccgttgccatacgcccacgcggcgtacgctgcaaaaagccttgctgaatcagatacggctccagcacatcctcaatggtttcacgctcttcgccaatcgccgccgccaggttatccagtcccaccggaccaccgaagaatttatcaataaccgccagcagcagcttgcgatccatatagtcaaacccttccgcatcgacgttcagcatatccagcgcctgcgcggcaatttccgctgaaatagccccgtcatgcttcacctcagcaaaatcacgcacacgtctgagcagacggttggctatacgcggcgtaccgcgcgcccgacgcgccacttccagcgcgccgtcatcgctcatctcaagccccatgtgccttgcgctgcgcccaacgatgtgctgcagatcgggcacctggtagaactccaggcgctgcacaataccaaaacggtcacgtagcggggacgttaacgacccggcgcgcgtcgtcgcgccaatgagcgtaaacggcggcagatcgatcttaattgaacgtgcggcaggcccttcgccaatcataatatccaactggtaatcttccatcgccggatagagtacctcttccaccaccggtgaaagccggtgaatctcatcaataaacagcacatcatgcggttcaagattggtgagcatagccgccagatcgcctgctttttccagcaccgggccggacgtggttcggagattgacgcccatttcattggcaacgatattcgccagagtcgttttacctaaccctggcgggccgaaaatcagcaagtgatctagtgcgtcgccacgccgttttgccgcctgaataaagatctccatctgggagcgcacctgcggttggccgacatattccgccaataacttcgggcgaatggcgcgatcggcgacgtcttctgcgatcgtggcgcctgctgaaatcaggcgatctgcttctatcatcctttacctcataacgcggcgcgtaacgcgtcgcgaatcagtgtttcactgcttgcatccggacgggcgatcttgcttaccatccgactggcttcttgcggtttataacccagcgccaccagcgcagcaactgcttcttgttctgcatcttccgaggttgggctggccggcgacgtcaataccagatcgaccgctggcgtaaagagatcgccatgtagccctttaaagcggtctttcatttcgacaatcaatcgttcggcagttttcttgccgatacccggcagcttcaccagcgcaccaagctcttcgcgctcaaccgcattgacgaactgttgcgccgacatgccggagaggatcgccagcgccagcttaggcccgacgccattcgttttaattagctctttaaatagcgtgcgctcttgcttattgttaaatccgtacagcaactgcgcatcttcacgcaccacgaagtgggtgaagacgattgcctcctgcccggcctccggcagctcgtaaaagcaggtcataggcatatgtacttcatagcctacgccccctgtctccagcagcacgatcgggggttgtttttcgagaataatgcctctgagtctgcctatcacatgacgctcctgcgtaaagggctgaaaagataatgcactatcataaaaaaagactggatgtttatccagatgaaaaacacgttattcgcctatctcaatggccttcccttcgaatcggtcgcgcaacaccaccgggtgccgccgcgccccatgatgtggagatataataagtgtctataataaatataattcaataacattttctgtaagaataataaataaaaagtccagatacgcattatcactatagcttgaatttcctccggtgaaagcacatcctttataaacatttttaatcatcttgttatttaatcattcaggacagaaattcaatgttattgaaaaatattgtcataggtgcattaatggctattcctgcgctggcgtcagctaatagcctcacggaaacacgggaaagaatggccattgagcaacaagctatcgcctatactgtcagccaaaagtgggacaagctggacgctatgtttcaggaatacaataccggattcccgacaaccagcggcggaactcataaactggttatcgcatggggagggatctataatcttttttcagtagatgtttccgacaatggtatttctggcgtggcaaaagagtggcttaaagcaaaccccaaatccacgggtgcaaggctgctgcaagcaatggtttttgatgctaaagccgtgaatttacgcggtgaaggtgcggccagcacggtggactctgatatatggccgaaatataaaaagctgatgattcaggaaaaagagtatctgttaaagaacaaagatattgccgacaaagatgtgacctggtatcaggaaatggaaatggtcgcacgcaatcttgaggataaagagctgctctatagcactttggaagaagccagcaaaaaatatcccgcctatcaaaatatttatatcgaggccatggttgctcgtttgcctaaatggggtggttctccggaagaagtcgaaaaaatcgccagaatggccgcagaaaaaaacaaagatcaatcgggactttcttactacgcttatatctggagtaatgcaatccattaccaacctgaattaatggctttactgaataaacgtcagattgtctcctgggacgatatgctgcaaggttggagagatcgctacaaacagttcccatcaacccgcacgcttaataatattctgataagctcctgcattgcccgcgataaagactcctttgtgaaagcagataaaatgattcaaggggaaacggagcgggatacctggccacaagggttaaattatcgggaatgccagcagtccttccaataattgccagattaccatcacagtttaatgcacagcattaattgaattaagccgcctctgccgttatatgcagaggtggtttaatgggaaatgtccttcaacctctggaccatgaacgagataaacggtaccgttgttaatcacttccttaccctttacaagaataataatcagcgattgatgaacagtacagactcgatatttttttgcattgcaacctaaccttttgcactttcgcctcctgttccccctggcgcttaatataacgcagagtcagccaaatatttgcgccaaccactcttgccagatcacacctcaaatgcctattaaaaacaaaagcaataagcatgaagagaaacacaaccagacaataacatagactcaaaaaaatatatggcgatacaaacaattatataatattgaaaggacagtccacttattccctgcgttcgtctatcttccctttcactttcacctctggaaagagataaaaacattatcaccgtaaattataatattcatgatggatatttattgataataatatcttgtcattatgtgagtataatgctaattatccaatagcgtaaaataaaggatattattttaggtaataatggaacgtgaacatgaaaaaacattattctgtccaatatgaaaccggggatatcgtctttacctgtataggtgccgcgcttttcggccagatatccaccgcttcacagtgctggagcaaccatgttgggattattattggtcataatggtgatgactatctggtggcggaaagtcgcgtccccctctcaaccgtcaccacgctgtcactgtttatacaacgttcagccggacaacgttacgcggttcgtcgcctgtgcggcggcctgacggtcgaacagaaactcgccatcatggaacaggttcccgcccggctgaataagttttatcacacggggtttaaatatgagtcatcgcgccagttctgctcgaaatttgtgtttgatatctataaagaagcattgtgtattccggtaggcgatattgagacattcgaagaattgcttcacagcaatcctgatgcgaaactcgccttctggaagttctggtttttaggttcaatcccgtgggatcgtaagacggtgacgcccgccagcctgtggcatcatcccaatttagaattaattagcgcctgtggaattgaaacccctcaacgcgaggctgagggagaatgatttagcgcaaccttccccgcgccagattgagtcggctctcgctcatttgcatcgcgttctggctaacatggcaatgcgtaatggcgatagccagcgcatccgcggcatcggcctgcgggttagcggggagctttagcaacgtacgaaccatatgctgtacctggcttttttccgcgctaccaataccgacgacggtttgcttcacctgacgcgccgcgtattcaaacacgggcagttcctgattgaccgcggcgacaatcgcgacgccgcgcgcctgtcccagcttgagggctgaatcggcgttcttcgccataaacacttgttcgatagcaaaatagtccggctggaactgcgtgatgatttccgtcacgcctgcgtatatgagcttcaaacgagacggcaaatcatcgactttggtgcgaatacatccgctgcccagataggtcagttgtctgcctacctggcggataacgccataaccggtaatgcgcgagccggggtcaataccgagaataatcgacacgctataccccctgcccgccggcgtttaacagcaccattacagggtcgccgccacctcatcagagatctcaccgttatggtagacttcctggacatcgtcacagtcttccagcatatcgatcagacgtagcagtttcggcgcggtttccgcatccatatccgctttggttgacgggatcatggacacttcggcgctgtccgctttcagacccgccgcttccagcgcgtcacgcactttgcccatctcttcccaggcagtgtaaacatcaatcgcgccatcatcataggtcacaacatcttccgcgccagcttccagagcagcttccatgatggtgtcttcatcgcctttctcaaaggagatgacccctttcttactgaacaggtacgccactgagccatcggtacccagattaccaccgcacttgctgaaagcatgacgcacttccgctacggtacggttacggttgtcactcagacactcaatcataatggccgtgccgccaggaccataaccttcatagatgatggtttccatgttcgagtcttcatcaccacccacaccgcgagcgatggcacggttcagagtgtcgcgggtcatgttattggccagcgctttatctacagccgcgcgcagacgcgggttggcatccggatcgccgccgcccaatttagctgccgttaccagttcacgaataattttagtgaagattttaccgcgcttggcatcctgcgcagctttacgatgtctggtgttggcccatttactatgacctgccataaatatttcctcaaaaaaagcgcgccttttcaggcgacgttaatgacaaactcttcaatcgcttgccggttactccaggacttggtaagcgccgccgcgtcaggcgcatcaagccactggtacgtcagatgttcagtgaatatcacctgccgctcatgcggtaacgcaaggcagaaccagaattctgtattgtgcataacgcccggcgcatagcgatgacgtaaatgtgaaaaaatttcaaactccaccgtacgttggcagtcgattaaggtcagttgctctgccgcaacatcaatcgtgacctcctctttgacttcacgcacggcggcctgcaacgcggtctccccttcttctatgctgccagtcactgactgccaaaaatccgggtcgtcgcgtcgctgcaacattagcacccgtttcgtatcctgcgcgaaaataaccaccaggaccgaaacggggcgcttgtacactttatccttcacgcgacctcgttgttggctgttgggtgacgccgcgcattgatgaggctcccccttgcgggccgccgcgatatcacgcgaatgatgtcgtgtacattgttcatatcagttattctcggctttcttcacaacctgaatacccaactccgtcaacgctgccaggttggcgaaactcggcgcttcggtcatcagacacgcggcggcggtcgttttcgggaaggcgataacatcacgaatattgtcggtgccggtcaacagcatggtcagacggtccagaccaaacgccaggcccgcgtgcggcggcgtaccgtatttcaacgcatccaacaggaagccgaacttctcgcgctgctcctgctcattgataccgagaataccaaatacggtttgctgcatttcaccgttgtgaatacgcaccgaaccgccgcccacttcatagccgttaatcaccatatcgtaagcgttagcgacggctccttccggcgcagttttcagttcagacgccgtcatgtcacgcggggcggtgaacggatggtgcatcgcggtcagaccgccttcgccgtcgtcttcgaacatcgggaagtcaatcacccacagcggcgcccatttgtcttcgtcggtcaggctcaggtctttgcccagtttcagacgcagcgcgcccagcgcatcggcaaccactttgttgttatctgcgccgaagaagatcatgtcgccgtcctgcgcgccggtacgttcaaggatagcctcgacgatgtcggcggtcaggaacttggccaccggactgttaatcccgtccagacctttcgcgcgctcgttaactttgatatacgccagtcctttcgcgccgtagatcttaacaaagttaccgtaatcgtcgatctgcttacggctaagctgtgcgccgccaggcacacgcagcgctgccacgcggcctttcggatcgttagccgggcccgcgaagaccgcgaactctaccgatttcagcaggtcagcgacatctaccagttccatcgggttacgcaggtctggtttgtcggaaccgtaacgacgttccgcttcggcaaacgtcatgaccgggaaatcccccagatccacgcctttcacttccagccataaatggcgcaccagcgcttccatcacttcgcgcacctgtggcgcggtcatgaaggaggtctcgacgtcgatctgagtaaactccggctgacggtcagcacgtaagtcttcatcacggaagcatttgactatctgatagtaacggtcgaaaccggacatcatcaggagctgtttgaacagctgcggcgactgcggcagcgcgtagaatttacctttgtgcacgcgcgaaggcaccagatagtcgcgcgcgccttccggcgtggctttggtcagcatcggcgtttcaatatcaaggaaaccgtgatcgtccataaaacgacgcaccaggctggtaattttggcgcgggttttcaggcgctgcgccatttccggacgacgtaaatccagatagcggtacttgagacgcgcctcttcggtattaacgtggttagcgtcaagcggcagtgagtctgcgcggttgatgatagtgagagaggacgccagcacttcaatttcgccggtcgccatatccgcattgacgtttttcgcgtcacgcgcacgcacggtgcccgtaacctgaatgcagaactcattacgcagttcagaggccagctttaacgcgtccgcacgatccggatcgaagaacacctgcacaataccttcgcggtcgcgcatatcgataaagatcaggctgccaagatcacgacgacggttgacccaaccacacagagtcacctgctgccccacgtgggacagacgtagctgtccgcaatattctgtacgcatgagatatcccttaacttagccgcaggcggattgttgcctgccatgcaggcgacgaagtcgcagctttagctgtatgtcacaactggatgaaaaaaggcggctattatactggaaattctgccgcacgataagagtcaatccagcatgggagcgataacttgcccgtttcatgcggtatcgacacttggttcatactgactgtacccgggtttttcacgcgggtattgcgtatgctcacaaaaattaacaatatttgtcgccgctttcctctttaatcgcgcttaaggtgtagtgaaatccgctatttttaggagagtgattatcatgctgaaactcaacgcgaccacaaccgccctggtggttattgatttacaggaaggaattcttccgtttgccggcggcccgtatacggcaaatgaggtggtcgcccgcgccgcgcggctggcggaaaagtgtcgtgccaacggctcgcccgtggttatggtacgcgtcggatggtctgatgattatgccgaagcgttaaaacaacccgtggatgccgcaacgcctgcgcacgcgttgccggaaaactggtggacctggcctacggcattgggtaaaaaggacagcgatctggaagtgactaaacgccagtggggcgcgttttacggcaccgatctggaattacagcttcgccgccggggtatcgacaccatcatattgtgcgggatctcaaccaatatcggcgtcgaatccacagcgcgtaacgcctgggagttggggtttaaccttattattgccgaagatgcctgtagcgccgccagcagtgagcagcatcagagcagtatgacacatattttcccgcgcattggccgggtacgcagcgtagaggatattttaaacgccttatgatctacattggcttgccgcaatggtcgcacccgaaatgggcgcggctcggcatcaccagtctggaagagtatgcccgccactttaactgcgtggagggcaacaccacgctttacgcgctgccgaaagcggaaattgtcgatcgctggtatgcgcaaactacggacgatttccgtttttgctttaaatttcccgccaccatttctcaccaggccgcgctgcgccattgcgacgatctggtacaggcgttttttacccgcctggcgccgctggaaacgcgtattggccaatactggctgcagttgcccgccgcctttggaccgcgcgatctccccgccttatggcagtttcttgatgcgctccccgccacgtttacctatggcgtagaagttcgtcatccgtgtttttttgacaaaggtgaggatgaacagcggctcaatcgcgggttacacgcgcgcggcgtaaaccgcgtgatcctggatagtcgtccggtacatgccgcccatccccacagcgaggccgtccgcgacgcgcagcgaaaaaaacccaaagttccggtacatgctgtcgtgacggccagccatccaatggtgcgttttatcggtagcgataatatggcgcaaaaccgtgaatttttcgccgcctggttgcagaaactcccgcagtggcggcagaccaccacgccttttctgtttttacatactccggatatcgcgcaggcgccggaactggtgaatacgctttggcatgatttacgcagcgtcttaccggaaatcggcactgctccgtccattccacagcaatcttctcttttctgaaaatgccccctatcatagacagtgccatcagccattttaaaagggagtttgtatggtaagcgcgctgtatgccgttttgggtgcgttattattaatgaagttctcttttaatgtcgttcgcttgcgaatgcagtaccgtgtcgcctatggcgacggcggttttagcgaattgcaaagcgccatccgtattcatggcaacgcggtggaatatattcctgtcgcgctggtgctgctgctgtttatggaaatgaacggcgccgaaacgtggatggtgcatatctgcggcatcattttaatcgccggtcggctgatgcattattacggttttcaccaccgcctgttccgctggcggcgggcggggatgagcgcgacctggtgcgcattgttgctgatggtgctggcaaacctgtggtatatgccctgggagttggttttctccctgtattagcgcacaatatgcgcctttatttttcccggatgtatacgttatgtctcaccgcgacacgcttttttctgcgcctatcgcccgtctcggcgactggacttttgatgaacgagtagccgaagttttccccgacatgattcagcgttcggtaccaggctactccaacatcatctccatgatcggcatgttagctgaacgctttgtgcagccgaacacgcaggtctacgatctgggctgctcgctgggcgccgcgacgctgtctgttcggcgtaatatccgccatgagcattgtcgcattatcgccgtcgataactccccggccatgattgaacgctgccgccgtcatattgatgcgtataaagcgcctacgccggttgaagtcgttgaaggcgatatccgcgatatcactattgaaaacgcctcgatggtggtgctgaattttaccctgcaattccttgaacctgccgaacgccaggcattgctggataagatttacctggggttgaatcccggcggcgcgctggtactgtcggaaaaatttagctttgaagacgcgaaagtgggcgagctgttattcaacatgcaccacgattttaaacgcgctaatgggtacagcgaactggagatcagccagaagcgcagtatgctggaaaacgtgatgctcaccgactcggtggaaacacataaagcgcgcctgcgtcaggcgggtttcgaacacagtgaactgtggttccagtgctttaatttcgggtcgcttgtcgcgttaaaagccggagttgccgcatgatcgagtttggtaacttttatcagctcattgctaaaaatcatctctcccactggctggaaacattgcccgcgcagattgcctcctggcaacgcgagcagcagcatggcttgtttaaacagtggtcgaacgcggtagaatttttaccggaaatgacgccctggcggctggatttactgcacagcgtcacggcggaaagcgaaacgccgctcagcgaaggtcagctaaagcgtattgatacattgctgcgtaatctgatgccgtggcgtaaaggcccgttctcgctttatggcgtagatattgacaccgaatggcgctccgactggaagtgggatcgcgtactgccgcatctgtcagatttaactggccggacgatccttgatgtcggctgcggcagcggctatcacctgtggcggatgattggcgcgggcgcacatctggcggtcggcatcgatcctacgcagcttttcctctgccagtttgaggcggtgcgtaaactgttgggtaacgatcagcgcgcgcatctgctgccgttgggcattgaacaactcccggcgctgaaagcatttgataccgtcttctcgatgggggtgctttatcaccgtcgctcgccgctggagcatctgtggcagttaaaagatcagttggtcaacgagggtgagctggtactggaaacgctggtcatcgacggcgacgaaaataccgtactggtgccgggtgaccgctacgcgcagatgcgtaacgtctattttattccttccgcgccggcattaaaaaaatggctggaaaaatgcggctttattgatgtgcgtatcgctgacgtttgcgtcactaccaccgaagagcagcgccgtaccgaatggatggttaccgagtcgctggccgattttcttgacccgaacgatcgcagcaagacggtggaaggctatcccgccccgcagcgcgcggtgctgattgcgcgtaaaccgtgatggattgccgaatgaccgttacgtatagcaccgtttctccaaaatagttcaagttgcagcaaggcggcaacgcagcaaatccccgggaacgtaggtagctacgtggccggggtgcgcgaggcggccaacgctgctgcggcttgaaatatgaaggagaaaaaaaggcccctgttgaattggcaggggcctggtacgagcaagcatcatattgggcgacatgatgcaacggtaaaaatcatttggcctgatggcgaacaatgattcctttcatttcagcgaccgccgcaccctctactctatagcgagaatactcgtccgcctgtatatcggcagacatcgataacccctgattgcgatagcgcatcggcgaaggcagtaagactccggcggaactgtgtacttcccgtactccggcatcgaggaaattctgcaggttatttgcacgaacccccgcaccagccataatggttggagcatccccctgggcaataagttccataattattgataaaccttgcgccgcatcggctttttgtccggaagtcagtactcttgctacgcctgcgtcagccagattctttagcgcattgaagggattagcgcacatatcgaaggcgcggtggaatgtcaccgccagcggcccggccgccgccattattttttccattcgcgacatatcgacatccccatcaacggtcaacacgccagtaaccagcccgggaaaacccaactctctgacgaggcggatatcttccagcatggcggcaaattcgccgtcagtgtagtaaaaatccccgccgcgaggacgaataatcggatgtacgggaatcgtaatatgctcgcgtacgctgcgtaagacgccgaaagaaggcgtaagccccccttctttcggcgcggcgcacagttcgatacgatccgcgccgtttcgctgcgcggtgagcgcgcattccatgctgtaacaacagatctcaagtaacgccatattcactccgctcggcaggttaatgggccgcctgttcgctggcgacaatcgcttcaatcgaccatggatgaaattttaccgtgatgcgaccatcggtcacggccagcgtagggtttggcaaacgttcatgctcgccctgtggcgaactggttttaaccactatccccggctgactaagcccctcatccgacaacaacgccagggccctcgcgttcaaggtctccggctcgccgggcagcacgatttcaatatgctcccacccctcgtgtggatagcgtttttctcccggccacggtaattcaataacagaaaaccgccagtgttccacacataccggttcatgcagtttaaacagacaaatcggcctgccgttgatgatattttccgacagtagctcgccgcattgttcaaaaccgcgacgccaacgctccgccgtcgtattctggtgacagcgcaatgaaatgtgatcggcctcaagggcgctaatctgcagaccaaggcgagtggaaagttctctgaacgccagagtgaatcgcggtaaatctgcggaaatatcatgcagttcatcaatgtgttgccagttcgccatatcaggacgctcttcttgctgtgaaaaccgctaatttacgctgttgcgccccggcaaccaacctttgatttgattgggcgtttattgaatgcttatgcagattattgttgcgtatatttcaggcgacgcgccgcgcgcgcaatgctgacgccaacgggcatttgcagtatactcccgccctaattcttaaactggcgcgggcaatacagcccgcttcataaacgtaaggtattccggtgaatattcaggctcttctctcagaaaaagttagtcaggccatgattgctgcaggcgcgcctgcagattgcgagccccaggttcgtcagtcagccaaagttcagttcggcgactatcaggccaacggcatgatggcagttgcgaaaaaactgggtatggccccccgacaacttgcagagcaggtgctgactcatctggatctcagcggcatcgccagcaaggttgaaatcgccggccctggctttatcaatattttcctcgaaccggcttttctcgctgaacaggtgcaacaggcgctggcctccgatcgtctgggcgtttctcagccgactcgtcagacgattgtcgtcgactactccgcgcccaacgtcgcgaaagagatgcacgttggtcatctacgctccacgattatcggcgatgcggcagtgcgcacgctggagtttctgggccatcatgttattcgcgctaaccacgtcggcgactggggcacccagttcggtatgcttatcgcctggctggaaaaacagcagcaggaaaacgcgggcgacatggcgctggcggatctcgaaggattctaccgcgatgcgaaaaagcattatgacgaagatgaagcgtttgccgagcgcgcgcgtaactacgtcgtcaaattgcagagcggtgatacctatttccgtgagatgtggcgtaagctggttgatatcacgatgacgcaaaaccagatcacctatgatcgtctgaacgtcactctgacgcgtgacgatgtgatgggcgaaagtctgtataatccgatgctgccgggcatcgtcgccgatctgaaagccaaaggactggcggttgaaagcgaaggcgcaacggtggttttccttgatgagtttaaaaacaaggaaggcgacccgatgggcgtcattattcagaagaaagatggcggttatctgtataccactaccgatatcgcctgcgccaaataccgttacgaaacgctgcacgccgaccgcgtgctctactacattgactcccgtcagcaccagcacctgatgcaggcctggaccattgtgcgtaaagccggttatgtgccggattccgttccgctggaacaccacatgttcggcatgatgttgggtaaagacggtaaaccgtttaaaactcgcgcgggcggtacggtgaaactggcggacctgctggatgaggcgctggagcgcgcgcgtcgtctggtggcggagaagaacccggatatgccggctgacgagctggaaaaactggctaacgccgtcggtattggcgcggtgaaatacgccgatctgtcaaaaaaccgcaccactgactatatcttcgactgggataatatgttggctttcgaaggcaataccgcaccttatatgcagtatgcctatacgcgtgtgctgtctgttttccgtaaagcgaacatcgacgagcaggcgctggcgagcgcgccggttatcattagcgaagatcgcgaagcgcagcttgctgcccgtctgctgcagtttgaagaaaccctgacggtggtcgcgcgtgaaggtacgccgcacgtcatgtgcgcatatctgtatgacgtcgccgggctgttctccggcttctacgagcactgccctattctcagcgccgagaatgacgcggttcgcaatagccgcctaaaactggcgcaactgacggcgaagacgctgaaactgggtctggatacgttgggtatcgaaaccgtagaacgcatgtaaacgcgccgtcgttaacatcatcaggcctgactccggataacggactcaggcctttttattgccacagcggtatatctgtaacaaatcacaaggaatgacacatttctatagagagatggaacatcttttacctgtgctggcgctgaccgccccgtatcattaggcggcggattgttcaggtacaggtaatgacttttaaagactttgatgcggaagagaaactcttcctgagacgtgtgattgtggcgtttggtgtagtggttgtctgctttggtatcctgatcttcaacctctataacttgcaaatccgccagcaccactactacaccacccgttcgaatgagaacgatatcaagatgctacccgtcgcgcccacgcgcggcatcatttacgatcgcaacggcattccgctggtgcgtaacgtaacctggtatgatatcgcggttacgccctataaaattgccgatatggatgcgctgctaaaacagctcacccctattgttgatctctcccccgacgatatctccgactttcgccgtgcgctaaaatccagtagccgctatcgtccggtggtgctcaaaaacgcgctaacggatgttgaaatcgcacgctttgcggtcaatcagtttcatttcaacggcgtcacgatcaatagctatcaggatcggcagtatccttacggcgcggagctggcgcatgttctcggttacgtgtcaaagataaacgataacgaccttaaagcgctggataaaaaagggctggcagagaattacgcggcggaccataacatcggtaaacaggggattgagcgttactacgaaaacgatcttcatggtaaaaccggttatcaggaggtcgaggtggataatcacgggcgtattgtccgcctgctgaaagacgttcctcccatcgcgggtaagaacattcacctgacgctggatctccatttacaagagtacattgaaagtttgctggccgggcagcgtgctgccgtactggttgaagatccgcacgatggttcagtgctggcgatggtatctatgcccagctacgacccgaacccctttgtaaaaggcattagctatcaggattacggcaaactgctgcacgataaaaatctgccgctgatcaaccgcgtgacgcaagggctttatcctccggcgtcaacggttaaaccctatatggcaatgtccgcgctgttatgcgggattattacgccgcaaaccaccttctttggcgcgccaacctggacgcttcccggcacgcagcggcattaccgggactggaaaaaaaccggacacggtatgctggatgtcactaaagcgattgaggaatctgcggatacctttttctatcaggtcgcttatatgatgggtattgaccgtatcgacacgatgttgtctcagttcggctatggcaaaccgacgggcatcgaccttaatgaagaatatgacgggctgcttcccagccgcgcatggaaacagcgggtccataaaaaagcctggtatcagggcgataccatttctgtcggcatcggccagggttactggattgccacccccatccagatggtaaaagcgatggtggcgctcatcaacaacggtaaggtgattgcccctcacctgttactcaatgaagagagcggcaaaacggtggttccgtatcgtccttcaggaacaccggcacagatagccgatccggcgtcgccatactggggactggtgcgtcaggcgatgtatggcatggcgaatgcacccaacggaacgggctataagttctttcacaccgcgccctacggcattgcggccaaaagcggcacgtcgcaggtatttagcctgaaagaaaatcagacctacaacgcgaaaatgatccccattcgcctgcgcgatcatgtgttttataccgcttttgcaccgtataaaaaccctaaggtcgctattgccttgattctggaaaacggcggaagcgacggcgttaccgccgcacccatcatgcgaaaaatccttgaccacctgtttgatccacaggctgataccacacagccggatcaggcgccatagtcaaataagcaaagcgccatcagacaaggatacggccggaatatctgcatacatcagaaatagttacgcagatattccgtcaaacacagcattgccatcgcctgcccgtaaggcatagaggtcaacggaatatgacggtaaaaatcgagatcgtggcccatgccagtgccaaatgacgtttgcagcagttcaccttccggcgagatatgtttcactatcccccgaatagctttttccgccacctgcgcatagtgccgttcgacatagcgtttgcgcaccgctttaagaataccgtaggcaaaacccgccgtcgccgacgcctcaagataagagtgcggatcgtcaagcagcgtatgccacaaaccgctttcatcctgacatttcgccagcgcggcgatctgcgcattcagtacctggaccagataacggcgcacggcattattttccggcaagtccagcagttcaagaaaatccgggatcacaatggtcagccagctgttgccgcgcgcccagcgagcgttagcgaagttatgatgaccgtcatagctccagccgtggaaccacagccccgtctctttatccatcaaattctgcacgtgcagcaggaactgataggttgcctcttccacgtattccggccggttcaacagtttaccgattttcgccagcggcagcaccgtcatcattagcgtgtcgtcccacatctgctgatgattttcctccgccagcgtgatgtgctgcattccgccgtgatcggtacggggcatttcattcatcgcccattcggcccacgtttccagccacggtaaatacgctggattacgcgtctcttcatagcgatacgccagcgttaaaaacggcgccatcgtattaacgtttttcgtcgtcgcgccttccgcaaaacgatcggcaaaccagtcatcaatgatcttacgcatcgtctggtcgccggtctgttggtaatagtgatacattccgtacaggcccacgccgtgcgtccactcccatccggcccagcctttagtatcgatcacgcgtccgtcgtccagtcgcaataaaaattcgcctgtctcatctttaatattgaccaggttatgcgtcaccttttgcaccagggcttttagttcatctctggcgataaaatgctcaggctgacgcaatagcggactgtgtttgactggataaaccatcatttgcttaacctctgtgtaatgtcgaattcagtgctgcgtgcagttttaccgccgacgcagtcgattcgctacagtaaaagctaagctgggcggaaacctttttgtttctgccattgccagagcgtaaatggcaaaaacgcaaagagtccggcaacctacctcaccattttataaaacagcgtttctatttattcaaaaagagagtcaggtctgctacctggcaaagaaaggggcggttagcggtagttcacaatcacctgattgctccgcacttttaacgccgggataagtcggccgccgccggggacttcccagacaaagcggagcggctcgactgcgggaacatgagcaaaaccgtgggtcgtgccactctgaccatcaagttctacgcaacgggactgggaacataaacgtacccgtaagcccgcgggagtcgggccattcagttcataacgccaggcgaccagcgtcatcacaccggaaaccggctggcgcgccgacaatggcgaagacgatgcggaaacaccccggtaatttaaggttacacccataccgctatcctgccacgcgccttcgcctgcggcctgaaccgtcaggggaaagagcaacaacgccagccatttacgcattattttcctccaatggtcgccgtcatgcggatatgacggttatcggaaagctcaaggttcgacaacaccaccagctgcggtaaactgcgccgcaaaaagcgggacaataatggacgtagcgcatggttaaccagtaataccggcggcgcgccaagcatttcctggcgagaaagcgcttcttgggtctgcgccagcaggcgatccgccaacccaggctcaagtccaccgccgccctgcaatgcctgaagcagcaaacgctccagcgcggtatccaggccaatcacctgcacttcttcattaccggggaaccactgttgcgtaatcgctcgtcctaatgccacgcgtaccacggcggttaattcatgcggatcgctttgtaacggcgcatgttccgccagcgtttccaaaatggtgcgcatatcgcgaatcgggactttttccgccagtaagttttgcaggactttgtgtaaagtcgtgagggtcacgacgccggggaccagatcttccgtgagtttaggcatctcctgagagacacgatccaacagttgctgcgcttcctggcggccaaacagttcggcggagaattggccaatcaagtggttaaggtgcgtcgccacaacggtactggcttccacgacggtaaagccctgaatttgcgcctgctctttcagggcgctttcaatccagatggcatcaaggccaaaagctggatcgacggttttctcgcccggtagcgttcccgccgccgtgccggggttaatagccagccagcgtcccggataggcgtccccgctgccaatctctacccctttcatcaaaatacggtagcgcgcaggctgtaaatccatattgtcgcgaatgtggaccaccggcggcaggaaccccatatcctgcgcgaattttttacgaatactgcgaatacgtccgagcaattcgccatcctgttgaaaatccaccatcgggatcaggcggtagcccacttccattcccagtgaatcctcaagctgtacgtcattccaggtggcttcgaccaccgagttattttccggcatttttaccggctgcggctcctccggcgctttttcttcacgcccgcgcagccaccatgccaggccgagcaaagcggcggtaaaaagtaaaaataccaggttaggcattcctggcaccatgccaagcagccccagcaccgccgccgccagcagcatcacccttggattactgaacagttggccaaccatctgctcgccaacatcctgatcggtactaacgcgggtcacaatgacgcccgccgccgtggagataaccagcgccgggatctgggcgaccaggccgtcgccaatggtcagcagggtgtagctttccgccgcgctgcctatgctcattccgtgctgcaatacgccgaccagcagcccgccgaccacgttaatgaccatgatgagaataccggcgatggcgtcgccgcgtacaaatttacttgccccgtccatcgagccgtagaagtcggcttcctgagtgacttccgaacgccgttttttggcctcgtcttcaccaatcagaccggcattaagatcggcgtcaatcgccatttgcttaccgggcataccatccagcacaaagcgcgcgccgacttcggcaatacgtccggcgcctttggtgatgaccatgaagttgataatgacgaggatgataaaaaccacaatcccgatcgcgaagttaccgccgaccaggaaatgaccgaacgcctccactacctttcccgccgccgccgcgccggtatgcccttccatcaaaataatgcgcgttgaggcaacgttaagcgccagacgcagtagcgtggtaaacagcaggatggtcggaaacgcggcaaaatccagagtacgctgggtaaacatcgccaccagcagcaccataattgatagcgcaatattaaaggtaaacaataagtcgaggataaaagcaggtagcggcagcaccatcatcgacaaaatcagcagaatgaggatcggcccggcaagaatttgccattgcgtcgatttcaggttgctgggcaggcgcagcatcgcgaccagattagccatcagtattcttctcgttcataaaatccagcgcttctggcaccggaaggttctcaggttgtggaggacgttgcccgcccgcaagccgccagcgtttaagctgccagacccaggccaacacttccgcaacggcagcatataactgcccgggaatttgctgaccgatttcggcgtggcgatataatgcccgcgccagcggcggcgcttctaaagtgggaacccgatgttcagcgccgatctcgcgaatgcgcagcgctattaatccagcccccttcgcgaccactttcggcgcgctcattttgttttcgtcatactgcagcgccacggaatagtgcgtcgggttagtgacaatgacgtccgctttcggcacatcttccatcatgcggcgctgcgcggcggcgcgttgcatctggcgaattttgcccttaacatgcggatcgccttcgctctctttaaattcgtcgcgaatgtcctgccgcgacatgcgtaattttttcaggtggctaaagatctggaaaaacacgtcaaatcccaccatcggaatcacgcccagtaccaccagtaacgcgcagagtccaaccagatccagcgcattccccattgcgacgatcggcgactccgccatcaggcgcatcatttgcggccagtgatgccagagataaaagccggtaacgcagccgaccagcgtggatttcaacaccgcttttagcaattccgcgccggtctgcgccgaaaacatgcgcttaattcccggcagcgggtttaatttagaaaattttggctgtagcgacttaccgctaaaaatcaggccgccaagcataaccggcgagataagcgccaccagcaccacgcccgcgatgagcggtagcagtgccatcatcgccgctttaatcagcaaaattatctgccccaggatcaggttaggatcgttcaccatacggtgatcgaagtgcaggcctgctgagagcattcccgccagctgccgcgctaacgactcgccgccgaaccaaataatacaaacgcccaccagcaatatcagcagtgaggtcagttctctggaacgggggatctgcccttcttcccgcgctttttcaagtcggtggggtgtgggggcttctgttttgtcgtcgtcgctctcttctgccacgcagcaaaccctggatagattgataagagagaatgatgccagaaccgctttacgccaataggcagagtaagcggtaaaaaaggcggggtttatggcgttaatagagatagccggatacgataagaaagtctcgtatccggccgggttgacggattcgaacccgataagcgcagcgccatcaggtcaaaaaagcttaaaagccaagactgtccagcaggtcgtccacctgatcctgactggcaacgacgccagctttcgaggtatccacctgcgggccgttgagcaagctttcgttctcgcgttttggtcgcgcgctctgttccgggatgttttccagcagcaccattaacaactggcgttcaatctcctgaatcacgtccatcatgcgtttgatcacctgacccgtcagatcctggaaatcctgcgccatcatgatgtccagcagttgcgcgttagtaaagctggtatggcccgggacatccctgagaaactggcgcgtatccgtcaccagttcacgggcgtcggaaagctcgatcggattgtcaaaccactcgtcccaacgttgggttagcgctttcgcctctttttccatcgcatcctgatgcggctgcgaggcttcgacactgtttagcgcgcgttccgccgcctgcgccgtcatctggacgacataatccagacggtcgcgcgcatcagggatcgcctccgccgcttcggcaatcgcctggtccagccccagttcacgcaggctgtcgcgcagcattcgggtcagactaccgatgcgcgcaatgatgtctcctgctgagccttcatcagcaggcttgatagatggttgcatcatcatcgcatcctcacatgcccagtttctcaaagattttgttgagcttctcttccagagtcgctgcggtgaacggttttacgacataaccgctggcgccagcctgtgcggcggcgataatattctcttttttggcttccgccgtgaccatcaacacgggtaacgccgacatggcgctatcggcgcgaatggttttcagcagctccaggccatccatgttcggcatgttccagtcggagataataaaaccaaagccgcccgcctggagcttgttcagcgcatcgacgccgtcttcggcctcttccacattgttaaatccaagctcttttaagaggttgcgcacgatacgacgcatggtcgaaaagtcatccacaaccaaaaatttaagctctttatccgccataaaatactactcctggttcaaatacgtatcgcctgtccggcactgattttcgccaacatctgctggcttacctggctaagatcgaccacttcgcttacgccacccatattgatggcctcgcgcggcatgccgaacaccacacaacttgcttcgttttgcgcaatggtccaggcgccagcctggtacatcgctaacattccagcggcgccatcgttgcccatccccgtaagaatgacgcctacggcgttgcgccccgcgtgtttcgccaccgaatgaaacagcacatccacggaaggccgatgccggtttaccggcgggccatcatgaattttgatttgataattcgccccgctacgcgccagctccatatgcttgtcgccgggcgcaatgtaggcatgacctggcaatacgcgttcgccgtcctcggcctccttcacgctgatttgacagagtttattcagacgctcggcaaacgagcgggtaaagccaggcggcatatgctgcgtaataatcactgccggactggaaagcggcagcggttgcagcacatgtcggatagcttcagtaccgcccgttgaagcgccgatagcaatcagtttttccgaactgagcagcggacccgcttttaaggttgtcggggccgccatcggtttatgtgcggcgatgcgggcccgcgcggcggtacgcactttttcggcgatcatctcgctatacgccagcataccttcacgaatgccaagctgcggtttggtgacaaaatcgatggcccccaactccagcgcccgtagcgtcacttcggaacctttcccggtcagcgaagagaccatcaccaccggcatcggtcgcaggcgcatcagtttttccagaaaatcgaggccgtccatacgcggcatctcaacgtccagggtcaatacgtccggattaaattttttgatgagatccctggcgaccaacgggtccggcgcagtcgccaccatctccatatcgctatggctattaataatttcagtcatgatttggcgcattagcgcggaatcatcaactgacaataccctgattttactcatgctttatccttacttagcgcatacaccgtctgtccgcgcaggctaaactcgcgcacgaggttgctaaagttttctgagtgaccggcaaacaacagtccgtcaggtttaaggagtggaacaaaacggcgcagaatgtcctcctgagtcgttttatcaaaatagatcatgacgttacggcaaaaaatcgcgtcaaagggaccgggtacgttgtactgcttttccaataaattaacggaggaaaattcaacataattggccagttcctgacgcacgcgcaccagtccttcatgcggccccgtaccgcgcatgaagtaacgttgtagctgctgcggcgataacgttttcagttcgctgaggcgataaataccgcttctcgctttttccagcacttcagtatcaatatcgctggcgaatactttccagcgaccgggggccatccctaacgcatccgccagcgtaatggcgatactgtaaggttcttctcctgtcgatgccgccgcactccagacgcggtactcgccgtggcggcgacgcgcatgttccgcaaggatgggaaaatggtgcgcctcgcgaaaaaaagcggtcaggttggtagtcagagcgttgataaaagcctgccactcagcgctgttttgattagcctccagcatactgagataacggccaaaatcatccagtcccagggcacgcagccgacggaccaggcggttataaaccatatcccgcttatggtcggccagcacgatccctgcgcgctggtagattaattgacatatccgacgaaaatgcgcgtcggacagcgcgaggcgctgtgtcatctgtaacaatactgacgtttgcccggagggcagagatgatgtcatagcgccttcttaatcacattcaaagtacaacgggcgcgccctgcggcagcgccatgcttcccgtattacacattttttgcttttatctatgcgaaccagacgaaaggtatcggcgggttcgcaaattaatcgataaccgacagcgcacgtcgatcagaaggtttcccagttcgcatcatccctggcggctaatgactgcggcgtattgccggactgagcgttcactgacaaacgcatctcaggtttatttaccgccagcggtcgcgatgccaggcggaaagccgataccgcctgggtcagacggctggcctgctcttccagcgcggcggcggccgctgcggattcctgaaccagcgaggcgttctgttgcgttacgcgatccatttcggaaacggccaaagcgacctgatcgataccccggctttgctcatccgaggcggaggcgatttcgcccatgatatccgtgacgcgcgtaacggcattgacgatgtcagtcatggtttccccggcgctttccaccagcacagaaccggtatcgacacgcgagacggaatcttcaatcaacgcttttatttctttcgccgcctgggcgctgcggctggccagattacgcacctcgcctgccacgaccgcaaaaccgcgcccctgctctcccgcgcgcgccgcttctaccgccgcgttcagcgccagaatgttagtctggaaggcaataccgtcgataacgctgataatgtcagcgatttttttcgaactgtcggcaatttcgtgcatagtgtttactacgccgtcgaccactttgccgccatgacgcgcggtctcggaggcgctttgcgccagttgcgaagcctggcgggcgttatcggcgttttgcttcacggtggccgtcagttgttccatgctggcagccgtctcctccagagcggaggcctgctgttcggtacgggaagagaggtcggtattaccggcggcaatttcactggtgccggaataaatcgcatccgaaccttcacgaacctgcgttacggtgtcaatcagcgagcgttgcatatgttcaaccgttcccgccagttcgccaatttcattacgtcctgagacggtgagcgttttcgtcagatcgccgctggcaatttcacggatatgagtaatcactcgcgctaatgggttaagcagggcatgacgaatgccgaaccaaaccaccatcaaaatcagcaccagcacgaccgcaagaacccccagttgccattgcgcaaaacggtagtcatgagcactttgatcaaatgtctggcggtacaggttttcgctcacccgggcgtaattgcccagcgcctcgcccaacgcgttttgcattccctgggttggctgggcgaagtaggcatccatattgccattgtccagaaactgaataagttcggctaatgcggcctgatagcgctgatatttttcatcgacgttcgcgctggcctccgccatcgctggcaatggcgtcatatttttgaaattggcgtagtgcgccgccgcctgtgcgagagtcgtttttgcattctggagtaaatccgttttggcgctgctctgctggttagaagcgtccatcatcatgcgtgcggcggagcggctcaggttaatgcgcgtttgcagcattaagtcccatgtcgacgtgagttcgctttgttgctgacgtaattcgttagaaataacaaaaccttgctggttatgctgtaatgaagaaaacagcaaaccaccggaaacaagctgtagcagtgcgaaaacccccagcaccatcatcagcattgtgacaacgcggatacggttaaacataaggcaccttcctgataacgagttatcaacgttatcggcacctgcggtgataactttacttttgcaaaaaggaaatacgctgttccggaagacgacattgccaatgacagtgtcgcagcggcgatgccggcgcaaaatgcaggggctgggcgcgggcgatgaagaggcactctcaccgctggcggaagcataacggtgaatattgccggatggcgcgacgccatccggcaacgttattacgcgacgtgtgatgctgcgatatccagcagcgccatctcttcgctgttaagcagtttttcgatattcaccagaatcagcatacgctcgccgagcgcgcccaatcccgtcaaatattctgttgacaaggtcacggcaaattctggcgccggacggatctgttccgccgttaacgacagtacgtcagacacgccgtctaccactatcccgacgacgcgttgccccagattcagtacgatcactaccgtattgtcatcgtactcaacgtcgccttcgcagaatttcacgcgcagatcgacaatggggacaatcacgccgcgcaggttagtcaccccttttataaaggccggtgtattggcgatgcgcgtcacctggtcatagccacggatctcctgcactttcaggatatcgatgccgtactcttcatttcccagtgtaaacaccaggaattcctgacctgacggctcgccggccagtttgcttacattactcataccggtcatattattcccttctcactcaatcaggcggctgtgatcgccatacgttgttcgcggtttaaaccctgcaatgcggaaacatcaacaatcagcgcgacgctgccgtcgcccaggatcgtcgcggcggaaatccccggtaccttgcgataattgctttccagatttttgaccaccacctggtgctgaccgatgagctgatcgaccagcagcgcgtaacggcgtcccgcgctttgcaggatcacaacaatgccctgcgtggcttcggttttcgccccgtccacgtcaaacactttccacaattcgaccagcggcaaatactcgccgcgaacttccagaacccgttcgccgcccgccagcggatgaagatcctcttcacgcggttgcagcgactccatcaccgcattcaacggcaggataaaaacttcccccgccacgcgaaccgacatcccatcgaggatggccagcgtcagcggcagcagaatacgaatcgtggtgccggagccttgttttgactggatctcaacgtgaccgcccatctcctgaatgttacgtttcaccacatccatgccaacgccgcgaccggagacatccgtgacctgttccgcagttgagaatcccggcgcgaagatcaacatgcctacttcatcgtcggtcatgttttcattcaccgccatcccctgcgacatggccttcgccaggatacgctcacggttaagccccgcgccgtcatcggtcacttcaatacaaatattcccgccctgatgttctgcggaaagaatcagattgccgacaacatttttccccgcctcaaggcgtttttccggcatttcaatcccgtggtcgagactgttgcgcaccaggtgcgtcagcgggtcgataatgcgttcgatcaggcttttatcaagttcagtggagctccccaccagcgtcagctctacctgcttgcccagtttgcccgctaaatcgcgtaccagacgcgggaaacggctgaagacgtactccataggcatcatacgaatcgacatcaccgactcttgtaagtcgcgggcgttacgttgtaactgacccatactggtaatgagatcgccgtggtttaccgggtccagctcgttagaacgctgggccaacattgactgggtaatcactaactcgccgaccaggtttatgagctgatccactttctctaccgccacgcgaatgctggtggactcgcgttcacgcgcaggtttttcacgccccgcatgatgttcatgggccgcgcttttggcggctggcgcaacgactgccggaggcgctaccggcgctacctcggttttctcttgcgctttttcaaccggcgcggcgaccactttttcaaaagcgatctgatcggcctcgatgacaaaacagagcaccgcgacaatgtcatcttccgcgacgctgccatccagagttgccgacagtgaatccgcccccttaacgacatccgtcagagtagccagattgcccaactcttcttcaagcagatcgacctcattggctttcaaccgtgaaagtacaatgcgcagtttactctcgtcacgaggcgattcggtttcggctacgctctcttcctggatcgccgcgcttagtgccgcggtttctacgaccgccggcgtggtttcgcctttcgcctccagcgccaactggcgtagcgcattgcagatatattcgaagcttgcggcatccggctcttcggagtttttataggcgtcgagctgttcctgcataatatctttcgtttccaaaaacaggttgataatgtcggtattgagctgcatttcaccgcgtcgggcttcatccagcaggttttccattaaatgcgtggtttcctgcagaatagtgaagccgaatgtgcccgcgccgcctttaatggagtgcgccgcgcgaaaaatggcgttcagttgttcagcgtccggggactccggcaccaaatccagcagatgctgctccatatcagccaacagctcgtcagcttcatcaaaaaatgtctgataaaaatcgctaatatccatgctcacgctatcacctcggttccgcttttggcgatgtgggtacgcttgccggcggggctgccgcaggctgttgtaatacacttaccggctcattctggctttcagcgttttcatgcaaaatggcctgttccgcctgtttgtttaacaccagcaggcttatacggcggttgatggcgtcatcaggaccgcgatcgctcagccgcatcgtggcggccatgccaaccacccgtaatacttttccgttatccagcccgccagcgaccagttcgcgacgagaggcattggcgcgatcggcggataactcccagttgctatagcctttttcgccgttcgcgtagggaaagtcatcggtatggccggccaggctaatgcgattaggtataccgtttaacactggcgcaatcgcacgcaggatatcgcgcatatacggctcaacttcggcgctgccggttttaaacatcgggcggttctggctgtcgataatctggatgcgcaacccctcctgaactaaatcaattttcagatgcggacgtaacgcgcgcagtttgggatcggattcgatcagttgatccagatcgccgcgcagtttgtttaagcgactctgctccatccgttttttcagctcgtcgatattcggctgcttttccacttcaccctgctgttgggtgtaatcatcgccgccgcctggtatcgggctctcgctattggcaatccgattcccccccgttaccgcggtggccaacggcgtacgaaaatattcggcaatctgaattaattctttagggctggagatggaaatcagccacatcaccagaaaaaaagccatcatcgccgtcataaaatcggcgtaggcaattttccaggaaccgtgcgccccgccgccgtgcggtttgtgcctgcggcgttttacgacgacaatgggatgagcctgatttttcatgcttcctcagtcgtctgctgctggtttgggtttctcactgcgcgaacgtgttcttccaactcaataaacgatggacgctcactggaataaagcgttttacgaccaaattccacggcaatcggcggcgcatagccgttcagattagacagcagtgtgatttttacgcactgcatcatcttggtggtttcggcgctcttctggcgcaaaacggtcgctaacggtgaaatgaatccataagccagtaaaataccgaggaacgtacctaccatggcatgggcaatcagcgcccccaactccgctgccggacgatcggctgaagccagagcgtgaaccacccccattaccgccgcgacgataccaaaggcaggcagcgaatcccccaccatcgccagactgttggccgggacttccgcctcgctttcatgggtttcaatctcttcatccatcaacgcttcaatttcgaacgtattcatgttgccgctgatgatcaggcgcagataatcgacaataaaatcaagcattaccgcatcggccagaatacgcggataactggcgaagatttcactctcttttggattttcaatatcgcgttcaagggagaacatcccctgctggcgtgatttggccatcaggcgatagagcaacgccagcaaatccatgtacatagattttgtgtatttcgaacgacgaaataacaacgggatagctttcatcgtgcctttgatggccttcccgttgttgccgacaatgaacgcccctatccccgcgccgccaatgatgaccagttcagcaggttgatagagtgccccaaggtgtccgccggtcatgacataaccgccgaaaactgtaccgataaccaccaggtaacctaataagataagcacgacatcatccttccgctgttgactatgacaggatgcgcagtcgggcgattaacgcgaaggcaaggcaaaaaaaagcagcggtaatgacttaccgctgctggagtgtttgtccacaccgtttcggttaaacagcctgttcgatctgttcatccagcagttgtggaataatatcggcagcatctcgggaaagtttacgtctttttactgcgcgggatggcggctggcataaactacacgcaaagctgcctacgggctgatgcgcatgggtaataaagttcccaccgcagcagttacagctcgacaattcaagcaacccactttcaacaaaacgcaccagcgtccatgcgcgagtcagcgccaacaacggcccttcaggcggttgcggacactgctcaagataaagccgataagctttaatcaccgcatccacaccgctgcataagccggtcttcagtaaaaattgccaggcgttgcagaacatggaggcatgaatattttgctcccaggtcataaaccagtctgtcgaaaatggcagcatccctttaggcggcgggctaccgcgtaattctttgtacagcctgatgaggcgaccacggctgagctgtgtttcgctttccagcatttgtagacgagcgccaagattaatcaactccatcgccaactggatatcgcgagcttcctgaacaatgcttttttcactcattatcatgcccttttcttacgcgccgtatcgtccacttcattgagcagacgcgttgaaagcatgatacctgtgtgaatctgctgtaagtcatcgacgcgcgaatcctgagtcaaacgggtgatcgtctgatgatcgtcaaaccggaaatgacaaactaactggttcgtctccgccagtttgaccatctgcggcagggtcaacgcgcccagtgtgtttgccatctcttcgttgataccgaggcggaacatcgcagatgctttgtcctggacgatcaaacgctgtgcaaggagtaaatatgacaaattgatgtcataaatgtgttttagcaactcggatgtatgcattgttcccatccagaataaccaactttatttttgtgcgacgtagccgcaccccgtgatgtcgccgggaaggcccggtaaaagaagcaaaaaggtcaaatgcatagcagcgctcagacattatggacattgtgacgtataacgcagcctcccactgagattcgccttacacgtttacatcaatttttacaaatgcctaagatttttcctaattcgacgcaactctactcgtcagcttcgtgacatacaacggagcgggacggcgattttagaaaatatgtgatgcagatcacatattttaacggaatacttacgataaaaccatcagcatggcttttactttgtttaattaataacctaatgttcactttttctattccacactgctgaataggggtacgtcaacaccaaattcttttttgtttctctctgttaaaataacgccaggataatagataacaggctattatttctattttagaaacgcttttattttacctttagtaaacagtagcttaaatattaaacgttattaattaatctcgtcacagcatacgccctccgctgttaaaaataagctcatttgatttaacttttagctttccttgttcacccatttaaatgaagcatccgggtggtgtgtaaaaagtgtcttatgccacgattctttacataagaataattaatgattaattatgatgtccttcacattaatgtggcattagcgcattgcagaaatgcgataaacagagtaaagctaaagcacaatctcatattcttgcaatcaaggagcgagttatgagctacacccatattcttgtcgccgttgccgtcaccccggaaagtcaccagctactggctaaagcggtctctatcgcccgccctgttcaggcgaaagtaagcctgattactctcgcttccgatcctgaactgtataaccagttcgccgcgcccatgatggaggatttacgcgcggttatgcatgaagagaccgagaattttcttaagatgctgggggaaaaggcggattatccgattgaacaaactttcatcgcatcaggtgagttaagccagcatattttggctgtgtgccgcaaacaccatgttgatctggtcatttgcggcaaccataaccacagtttcttttcgcgcgcgtcctgctcggcaaaaagtgtcgtcagcgccagccaggtagatgtgttgctggtgcccttagcgggcgactagtcgccgctcgcgatatttcaggccagcttagggaacgtcgccacgttgttctgctgctgacgctcagggctacgcggcgtgacctcctttaggtcatgaataaaacgctcctgccagcggttaatgtcatttttaacgatcacgtccagcatctccgcatgacgcgaaatacgctcggcaaggggcatcgttagcgcacgattgagcgccgccgccacgtcatcccgatcgtaaggattgacgattaacgccgacgtcagttcattcgccgcgccggcaaactgtgacagtaccagtacgccagggttagcggggtcctgcgcggcgacaaactctttcgccaccaggttcatcccgtcacgcaacggggtgacgagcccgacgtctgaataacggaatatcttcattaacagtttacggtcgaaatgttgattcagataatagagcggcgtccagcccaattgtccatatttcccattaatccggcctgcttccgtctcaagctggtggcgaatatcctgatatgcctgtacttcgccgcgtgacgtaggcgcaatttgggtataacgaatttttccccgatgctgcggatagttttccagtagcgcttcatacgccagaaaacgttccggcagccctttcgaataatccagccgctcaacggaaaaaatattcttcacatttttcagttccgccttgagctgcgccagtttaggcggcaacggcccggcagcctgcagagcaatctcatcgggctcaataccgataggatacacttctgtctggaagtctttaccccacgcgatatgctgcttgccgctgcgagtcgtgactcgcgtttgactcgaaaggctatccagaaaagccaggcgatcattttcggtctggaaccctagcagatcaaagtcacacaactgctccagcagttcatcatgcggcggtaaggcgttaaaaatctccggggtcgggaatggaatatgcaggaaaaaaccaattcggttgttcacgccgcgtttacgcagctcgctggcgaacggtaacaggtggtagtcatgcacccaaatgatgtcgttctctttaatgaggggcaataacttatccgctaataacgcattcacccgcatatagccttcccatgcaggacgctgaaactgtaccaggtccagacgatagtggaacgcaggccagagaaccgcattggaaaattgacagtaataatcttcgtaatcttgttcgctcaggttaaacgatgcccaggtaatattaccttttgtcaccttttttaatggctcatcctcgttacctgtctcgccactccagccgaaccacaacccgccagccgcttttagcgcgccaagcacgccaacggcgaggccgccggcgccgcctttattatccgggggggcaattcgattagatactacgactaaacgactcatagccatctctcctgttattcattacttgttgttcttgttgtggataattgatttgttccagccagcgccagacatcgggtacgctttccagccgccatgccgcctgggttgccccgacgcccacttttacggaaattccgccagcgtgattcaccacgccaaagccagcctcatcggtcaaatcgtcgcccacaaaaacgggaatccgtcccgcaaagggcgcctcctgcataaaggcggcaatggcttcgcctttattggttcccttaggtttgatttccacaacacatttaccaggctgcaacgccagttgcggccagtgctgcgtaacgtgttgcgcaagcgccaacagcgccgcttcatgttccggagcctgacggtagtgcagcgcaaatgccatccccttcgactccagctccgttccgggcagcgctacaagcgtcgaacgtaataacgcctctacctcacggactaccgcttcaggaaggcgcacgatatgggttttaccattgatgtcacgacgctctgccccgtgaacgccagcgagtggaaagcgaaaaggcttcgccaaagcatccagctcagtcattgaacgccctgaaatcaatgccagtgcccctgcgttgtgcgccgcgagacggtctaacaactgaaggattttatgcggtaccactacctgatcgggatgaggctttatctctgccaatgtgccatcaaggtcaaaaaaatacgcatagttcgcagtgagttcgggggatacggttaacggttctgccaccctggtctcctccttatcatcatattgagactcacaaacggtctcattagtcatgtaagtatagacagtgtgacgctgctcgccatttagaaagaccatcgccagccggggtagcggctggcgatgacgtgaagctatactgtttagttgagtgttaattcatcaaatcgtacgcttcgctttttgcttataatggtcgaagataactgttgtcagaaggattcagccgcgaaccatacactgtgcaaaaggtgaaatgttgagcaggttcatcgcgctctccaccgctcctgatatcagtacgctcgccaccacatatgagacttttccgaggccgcctttcaggaatccccccctaagacacacgcagaaataacgattaactcataacccagggaagtcattgacctgctttagcgttttttatgtagggtaaaatcaaacgattcttgttagagaagacgtaaaacggtgcactgtctttcattcattagataaatgctgatggcaggaatagttttagcggaaaatgacataacccagagcgaattcatcagccaaaaggcaggaaagccagcacattaatccataacatcagccagctaatccttacggccctgggtgaataacgattaccagggataatagatatgttcagcctgttcgcgaaccggcgcatcgtctcccagcagtctggcggaaagggttagcgcgaaatcaaagacatgacccaaccctttgccgctaattaaattaccatcttcaaccacgggcgcatccacatagacaccttccggaaccgctttccacagatcgccggaacagacataacgacgccccttcagcaatccgtgagcacccagcacccttgccgccgcggaacagataggacaaattaatttgcctgccgcatcatgacgcgcaacgaaagcgatcaccgccggattagccgccagattagcgctcccctgcggaccgcccggtagcactaccgcatcgaaaagcgcctgctggcgttcactcagcgtgctgtccgcaaccataggaatatcatggtaactcaccaccgcccgtgattcagcacacgccagcgtttcgacgtcgatatgcaaacgtcgcagaatatcaagagtaacaatggcctctgcttcttcaaatcctggtgccaacagcaccgcgacctttttcattgactgctccttgttaacgagtcacccagcaaaactgcgctcaaccgaataacgtgctcgtatgattaatgatattaaaaatgatctaccgcaaaatcggctagtttataaaaacaggcatatttgctctcaaccgtttatgcgtgtgatatccagactgactaatgtttattttattgaaattaacatacttgaaaggcttaacccatgatctgaaacaatgtttcataaattacaaatctatataatatcatttaactttcaaagggttgcaactgctcctcatccaaaatcattacacctgaaaaaatcacaccgctgaaaatgtaaaaaaagataaacaattgcatttaaggattttcttatttttattgacgcgctattctcattaccgatcgataaacaggaaatgagatcgcataagggactggcggaacggagttcttctgctaagagtatttattgtgcatagaggtaagaatgtgacaacggcccgttgcattctcgtctgtcatgcacatcaacactttctggaaataaggatattgttatggcagctgtaggaatggttcaaaagctcaacacgccaatgaaccttgagttttacgcatcaaatctttacctccatctaagcgaatggtgttctgaacacagtttaacaggcaccgccacctttcttcgtacccaggcgcaaggcaacgtgacgcaaatgatgcgcatgtttaattttatgaaaaacgccggcgccacccctatcgttaaagccattgacgttccgggtgaagagctctgctctctggaagaattgttccagaaaaccctggaggattatcagcaacgcgccagcacgctgtcgcgtctggcagatgaagcgaaagcgctgaatgatgcctcaacgcttgattttctccataccctggaaaaagagcagcagcaggatggcgtacttttacaaactattctcgaagaagttcgcagcgctaaacgagcagggctatgcctggcgcaaaccgatcagcatctccttaacgtcgtgacctatcagcatcactgatagcggcaccccgagcgacaatattgagacgttattagccggatagcaacgcgaagcagcttatccggcctacaccgtttctgatctgtttgccagaggtggtgcctgtcgctactggcgtattatcggcacatcatgccagccgacaggcgcgaaacgcctctgtcttgtctgggcattaccccagcatctcacgtacaaacgcttctatttctttattctggccgttttcaaacaaacattgctggaaacgcggccctgaaaccgccgttttaaccagttcaggatcgatagcccgtagtgtatccagataattctctttgacgaccgcggccttaacctggttcaaaatgcccgcattgcgtacctgcggcgctttgcgctcaggcggatacccctcgcctttacgcccggtaaacgctttttcaaagatgaaacgcacgttcagctcagcgccccagccaaagcctttcgcaaatggcagggacaacgcattgccgttgttgatctgcgcaaacagaaaagcatctgccggatcgatgcaatagccacaaatgacacctggatgaatatttaacgacatcagcgcgccctgaccagtgccacagccagtaaccacaaaatcaaccgcgtttgcattaagcagaatactcgccatgatgcctaaatgaatgtacgtcaggtgatggtcattttcgtcgcacatgccgacgttaaaaacgggaaatcccttttcattggcgacggcgctaagttcgttataaatgatggcatttttgctggcctggctattttccatcatcagtgcaattttcatcgtgtttctcctgaatgcagacggtcgcgcctgcgtaaatcatgacgttttacccacattacacatttgagaacacacattcaaatttaataaaaccaggtttcattaaatgaaaagacgctcacacattttctgttcccgctgtaaatcccctgccgttacctttaatcaaggcgaatccgtaagttattccagccattgacagtgcaagacacgaggtagcatggtctgataccgaactgtcggagcgattttatgaagcctcttatttttactctttcactgctagccctgacgggatgcaccattactcgacaagcgcaggtcagcgaagccagcccgataagcggcatcgtgcgcctgacgtataaccagccgctattttttacttcacggacagatgattatgtatctcacgggaccgcaacacgcgaatgccagcagatgggctatgccgatgccgtttcgtttggtcagccggtaggaacctgtagcatttatgcgggctcgttgtgtctgaacacccgatttaccctctcctggcagtgccggggcgttgccgtcccgcaaatcatgccgctttattattaaggcggctggcttaacgtcgacaccatctacaatggaggagagtgcagggtcgctattgccagcatgaaggtgctggctttcctttatttttatacgctatacactggcgttaatgcgttttattcccattcgtatttttaataattaaatttaatattttaccttttgcaaataataaaataacaaattatagtggcgccacattaccgtatatcttttgctatttgtggagcggaaccatgctgaaaacagaaatgatcgacaaactgaatgagcaaatgaatctggagttgtactcctccctgctctatcaacaaatgagcgcgtggtgtagctatcacagttttgaaggcgcggccgcatttcttcgtcgccatgcgcaagaagagatgacgcatatgcagcgcctgtttgactaccttaccgataccggaagcctgccgcgcattcataccgtttcttcgcccttcgctgagtacgcctcgctggatgagctgttccgcgcgacctatgagcatgagcagcttattacgcaaaaaattaatgaactggctcatgccgcaatgaccagccaggattatccgacatttaatttcttgcagtggtatgtggcagaacagcatgaagaagaaaaattattcaaatctattattgataaattaacgctggcgggaaaaagcggcgaagggctttatttcattgataaagaactctccaccctggatacgcaaaattaatccaacacgtccttacacggtgagacgcgctctcaccgtggcgtattaatggcggcagattttactctcatgcgttgaaaaaccgtcctccaccgcaataaactttcctttcgccgccagaaacgcgaccagttccgccgccgtcatatctgatgctgaacaagtgtgaaatcgtgcccgctcgccaaagcgcgcttttattgccgcctccagcgaggtatgcgtgtactgctcgccagactcaatcatcatgttgagcacttcgtgaccatgaatggaatccataacccctcctgaataaaactcgtagcctaatgtgtccgtgtacaagcgactttgcgctagcgcaggtttacggcggttgtccgcgtctccttccatattcgcttttatgcccggaactgtaaattttacagtacacccattgtaacgaccatttgacgaaaatagcgtaatgccttaccctgcgccgcggatatcaccgttctttgttaccggggtagtagaaagcgtgaaaaacagaactctgggcagtatttttatcgtggcaggcaccactatcggcgccgggatgctggcaatgccgctggcagcggctggcgttggtttcagcgtcacgctgggattgttgattggtctgtgggcgctgatgtgttataccgcgctactattactggaggtatatcaacacgttccggcggataccgggctgggctcgttggcaaaacgctatcttgggcgttacggacagtggcttacgggattcagtatgatgttcttaatgtatgcgctcactgccgcctacatttccggagccggagaattactggcatcaagtattaataactggcttggcgccacgctctcgcccgctgccggagtactgctgttcacctttgttgccggtggggtggtatgtgtgggcacctcgctggtcgacctttttaaccgcttcctgtttagcgcaaagatcatttttctggtcatcatgcttgcgttgctcacgccacatattcataaagtaaatcttcttacgcttcctttacagcaggggctggcattgtccgccataccggtcattttcacctcgtttggttttcacggaagcgtaccgagtattgtgagttatatgaacggcaacattcgccggctgcgttgggtctttatgacgggtagcgccattccgctagtggcctatattttttggcagctcgccacgctgggaagtatcgactcgccgacattcagagggctactggccagccatgccgggttaaatggcctgctgcaggcgctcagagaagtggtcgcttcgccacatgtcgaactggcggtccacctgttcgccgatctggcgctggcgacctcttttctgggcgtagcgctaggattatttgattacctggccgatctattccagcgccgcagtacggtgtccggacgcctgcaaaccgggctgattacctttctgccgccgctggcgtttgcgcttttctacccacgtggatttgtgatggcattaggctatgccggcgtagcgctggcagtgctggcactactcatccctgccatgctggtctggcaatgccgtaaacagagccctcaggcgggatatcgtgtggcaggcggcacgccagcgctggcgctggtgtttatctgcggcattgtcgtgattggcgtccagttttcgatcgcactggggttcctgcccgatccaggttaacgccaggcaaagattaccgggcccggacgccgtccaggctcgataatcatcacgctatggccgtttacgagccattaatgcaggcagcactgcttaaattttttgccgctcccgcatggacaaggatcgttacgccccactttcacctctgcttttatcggcatctgtagcggcgtcgtgtgcggatgcgccatccaccaggcatgcagctcaagcgccgcgatacggatagcgtcaacgcttttatcgaacgcttccgggctcattttatccaacagcgcaaagttttcttccgtgccgtgtaaggcaatcgcttccagcgccggttttagcgtatccggcaagtcagaccagtcggacagcgacactccgcgcatgtaaccaaagcaccattcttcaacaatcgttaattcatggccatcaacttctcgcaggccaaacagcggctcgaactgttctggatagtcttcaagccgggcggctgtgtccgccatgtgctggaacaccagatccataaatcgcgtcatttctttttcagatgtccagcgcggtacgtacgcgggtcccccccatatcgcgaccagccactgttccgggtcgatgggacgcggagaacttagtaccgcagtaatcagaccgtccagctccgcgacatccaaaatggcctgatcggtattgtatttcgtcagcacatcatccagccattccagctcgttctcgtttaatggttccattttcataacgcttttcctcagtgatgacttccgcctgtaggcctcttacattgcagcggataaaaataatttttttgcaggcagttggatggcaaccatcaggggccagattaacacgaaatgaggaggattccggaagttaacgcacaaaaggaggatcagggcgcagattttccgccaggaagcgctcgccccacacaaaagcgagagatgggtttctcgctatattatactcatgctaacttataccaccgccgcggacagataaaaccgccctctcaaatagagcttattttcagtaaaaaagtgtttaatgagttcgtctaccgcttctctgtcagcagaaaaggttatttccataaacagcgtatcgtaccctattttgatattttttttcttacagtaaacacggatctcatcctgcacactcagcaacggcaggctaaatgtgtatagcggttgcggttcttttttcgccgctttctcaaaaactttagtgaccagatccccaagatcgcgctctgaccgggcaccgttattaaaatgcaataaattacgtctttttaccacccagcctccagccagataccgccaacaataactctcacttcaatgtgtgaggcacataatcacatccagaatcagctccagatagtatttcaaataaacagcccgcactatagcgcatacttttttcagacacagtttacagggatactctctttatatccacgcgcacggttgccttaatcatgtcttccgcgataacacagtttgtcaacctattctatataaccaagcttaaacagaaccttaccagccagtgatatcagctcaggactttcaggataaaaacgcagtaacggcaaaaataccgcctcaccgataatgctccggctattagcatggtttgggcgcaatccccagatattctgataagtcatcggcacgacctgcccattcatggttgtgttaccgatatacagcataatatgccctggaatatagaccagcgtagtaaacggttttccgtatctggtgagataatcgatccgcatttggggacttttatgactaagatcgaccacccgtccagcagcctctacctgcgcggatgaatgtctgggcaggaatatgccaaacggcattaacaggctgcggatttcggctgaacaatcattataaaagttaaaatttccccaaccgtagggggcgccgtacattgctttcattagcacggcgatattttccggcgtcattttccacggcatagccgtaaactcgttaccgcttagccagacccaatggataaacgcgcgaccgttgctgccgcgaactggcgccgcaatcaggaactggcccgcccgttgatgtcggaacggtaaaatagtgcccggtcgcccggtgaaataatagacgcctgcgacatggacagaaaccggcgcgttgataaatgcccccagttgcttatgagcaagcaaaacccactgtgttataaatttctgatccgtactggcaatatcttcactatgaacccagccagttaccgctggtgaaacgacatattgccagcgttggtctttgctcttcgtcagcgtatagaccggcgtaccgggacgcagcgaagacatttgtaaattatcaaacgggtacccctcgcccgcctgacggggatcgttaaagagcgggtcgtccgttggcagcgctctgactaaactttctctgaccataatacctcgccgggaggcatgatagatattgtcaatctgcgtatccgtattccctctaacctcctctttccagcgagaggtataaagtctgaagttttccccccaataagcactgccgtcgctaagaaactgcttaatactggcatcccgcgcctgtgctgcgttttttttcagcaatgcggtaatataaaaaccattccacggcgagtgcgcttcactgtccattccgaaataatgagattttagtgcgttaaagtagcgttgttgggtagcattatcaataaccggaatagtgtaatcagccgagtccggaggtatccatttatcaaccgactgtgaataatccgctaacggaaagcgtgtttttgtcgggtcaatatagctccctgtgaaaatttcatctttggctgttgatcggtaggtcgtctggtggcaagcggtgaggcacaatggtatcaataaaacggcccaggttttcttttgcatcatcatctccgtaaagcggggaaagcataatatagagactgaccaaaaccgccattcacgaaaacctgaaattatctgtagttgacctgttattaagacaatattgcaaaacgtgattaaagcatgatgcggatcacattaccttatgatgaatattagttcgctatctacctttaattaaactgtgcagaaaacaccctgaacagttatatactcgtttaatttgcataaatactccactgacccgcccctgtttttttcagacaatacatactgtagcgcgtcagttctactttttttatatactctgcaaagtcgttttcatcgacgtagccaataaaattacgcgcatcacatgtcgaagaggaaagctctcctggaaaagagtaggttacgattgcactctcaggctcatacaaaataaaaaaaagtagcaaagcgcaacctacaatcccaatattaatgaagctaataaataattttgcattatcggtatatttcactggcagacctactctctttaataaagcaggcataaaacatatcagcattttttatagagattaatggattttatcggctgatttacccgacgtttagtaattaccaggcataagttcttgcgggtcggtagcacataactgttgtactggcagaaatgccgctaccgatgttttttactgtgtatcgcgctggaaagttcacgctcgcggtcggcatacaaattgaaggcacaaaaaaaccacccgtaggtggtttcacgacactgcttattgctttgattattcttgtctttcccatggtacccggagcgggacttgaacccgcacagcgcgaacgccgagggattttaaatcccttgtgtctaccgattccaccatccgggctcgggaaaaattggaggcgcgttccggagtcgaaccggactagacggatttgcaatccgctacataaccgctttgttaacgcgccaaatttttttggcttttcagccagcatccgctttacgccaatgcttttaaactggagcgggaaacgagactcgaactcgcgaccccgaccttggcaaggtcgtgctctaccaactgagctattcccgcagtatcaagcaactttgttaatcacttgattttgttatcgtctggcaatcagtgctgccgttcgatgcgttgcattctacttacctgacgcactgagtcaacgatatttttcgtcactcacgatcgtttgctgaaatttgcggcgaaacgatcactgatcaagcaaatctccgcgtgcagcgctcaaatattgcaacatggaccacaatgttagcaccgctgcgacaaagaaaagcgcgatcccggcatactctacccagatattcggacgccacaagagccacgccagcgccaccatctgcgcggtagttttgactttaccgatccaggagaccgctacactactgcgtttgcccagctccgccatccattcacgcagagcagagataataatttcgcgggctatcatcgtcgccgcaggtaacgtcacccaccagctatgataatgctcggtgaccagcaccatggcgatcgccaccagcaccttgtcggcgacggggtcgaggaaagcgccgaaacgcgtactctggttccagcgtcgcgccagaaagccgtcaaaccagtcggtaatagcggcaatacagaaaatcagcgcgctgaccatcggcgcccaggcgaacggcaaataaaacaccacgacaaagaatggaatcaggatgacgcgaaacagcgtgagcaacgtagggatattaaattgcatagtgacgggtaactatctgttgtcagtgaaattacccctatgttgctacagtggcctcaatgtttcaacgaccagaagatcttttctgccagaccttgcgaaatacccggcacttttgcaatttcttctacgctggcgttacgtagtccttgcaaaccgcccatatatttcagcagcatctggcgacgtttaggcccaacgccttcaatagtttccagcgtactggtatttttaaccttcgcgcgttttttacggtgcccgccgatcgcgtgatcgtgcgactcatcgcgaatatgctgaataacatgcagcgccggcgagtccggcggcaggctaaacccctcgccttccggttcaaaaaagagtgtttccagaccggcctttctgtccgcgcctttggcgacgccaagcagcaaaggacgatgcttatcccaggggacatccagctcagcgaaaacggctttcgcctgggcgagctgcccttttccgccgtcgatcagaataacatccggaatcttactttcttctatggccttgccataacgccgacgtaacacctgattcatcgccgcgtagtcatcacccggcgtgatgcccgcgatattataacgacgatactcggcgcgtaacggcccgttagcgtcaaataccacacaggatgcgaccgtttgctcccccatggtatggctgatgtcaaaacattccatccgcttgatcgcaggaagttttaataccgccgccagcgcgctcaaacgctgcgtgatggtggactgctgcgagagtttagtgattaaggccgttgccgcgttggtccgcgccagcttgagataacgggcgcgatcgccgcgcggttttgtctggacatgaatacgccgtccggcaagttccgacaacgaatcggccagcagcgttttatcactcagattaaaatcgagcagtatctcgcccggtagcgtgcgcatctggctaccctgcaggtaaaactgcccgacaaaggtttccaccacttcgcccagttccgtaccaccaggtacttttggaaaatagctgcggctgcccagcaccttaccctggcgaataaacagcacatgcacacaggccatacccgcatcaaaagccacgccgataacgtcgagatcgtcgcccgcattggagacaaactgtttttccgtgacccggcgtaccgcctggatctgatcgcgaatacgcgccgcctcttcaaatgccagatcctggctggccttttccatccgggcaatcagctgtgttaagacctggtcgtccttaccggacaaaaacaaccggacatactccacctgttgcgcatactcctcctcgctgaccagtcctgcaacgcaggggcctaaacagcggccaatctgatattgcaggcaaggacgcgagcggttgcgatatacgctgttttcgcactggcggatagggaaaattttctgtaacagcgccagcgtttcccgcacggcatagccattaggaaatgggccgaagtactcgcctttcgcatgtttggcgccacggtgcatcgccagacgcggatgggtatcgccgctcagaaaaataaaaggataggatttatcatcacgcaacaacacgttgtaacgcggttgatacaacttgatgtaattatgctcaagcagcagcgcttccgtttcggtatgcgttaccgtgacatcaatgtgttgaatttgcgcaactagcgcttcggttttacgcgaagccaggttgctgcgaaagtagctggaaagacgctttttcaggtcttttgctttaccgacataaataaccgtaccgccggcgtcatacatacgatagacaccgggttggctggtaacggttttcaaaaacgcctttgcgtcaaatatttcactcactggcttgttaacgtctccgcattacacaggccatggcggattgccaggtgagtcagctcaacatcaccatgaatgtttaatttactgaacatacgatagcgatagctgttcaccgttttaggactgagattcagctgttctgaaatctcattgaccttctgacccttggtgatcatcagcataatctgcaactcgcgttcagacaaactggcgaacggcgtttccgtttttgcaggctcaatctgactgagcgccatctgctgagcgatatcggaggcgatataacgttgtccggaatacaccgaacgaatagcgctcaccacctcctgaggcgcagcgcctttgctgagatagccagctgcgccagcctgcatcactttggcgggcaacgggttctccgtatggacggtcagcatgatcactttgatatccgctgtcgagcgggcaattttacgcgtcgcctcaaggccgccaataccgggcatgttcatatccatcagcacgacgtcaacggcgttagtacggcaccattttaccgcatcctctccgcagcacgcttcaccgacaactttaatgccctttatatcttcaagaatgcgtcgtatccctgcgcgcaccagttcgtggtcatcaacaagaagaacgttgatcaaaggaatatctccagaatagggataacgctactgatagttaatcgtccttatattagctggttttatctcaactttgaaacgtaaaaaaacaccgggtattcgattttgctctcgtttttggaaattatgttgtacgtcatgtggcaactgccaacgttgtagccccttctggcggcgctgtcccgggctgatatttcataatggtgacaaaaatttcacgttccgctgtctaaacactaattagagaatcaactttgtaacaataattaacgagtgaaatacgcgtaataaacaaagaatgaagaaaatatatgcatcacgcggcaacgtttattttgtgggtaacccctccgctttttgatcaaaaaacaaccactgctatttttagcgtagcttatggtatactccgccgccttaacatctgctatcgcacattttcactgaaacataacgaggaaaataaatgagtacgcctgatttttccaccgctgagaataatcaagaactggctactgaagtcaactgcctgaaagccatgttaacgctgatgctgcaggcgatgggccaggccgatgcagggcgcgtgattcttaaaatggaaaaacagatcgcgcagatggatgatgaagcacaagcggcggtattttccagtacggttaagcaaattaaacaggcttaccgccagtagtaaaaaaccggctgttagcatcgctttcagccggtttcgcgtctggcgcgaagcatcgtcagcacgtcatatcagacctgtcgccgcagcgtagcaggcaatctgtgttttatttggcgcattgaatttcttctgcatatttttctgatggaagttaacggtattttcagaaatcgacagaataatggcgatctccgatgaggtcttcccttccgccgtccacttcagaatctctttctcacgtttactgaaacgcatttcaggcgccatcaccatgtcgtcttcaaatcttgtcagcgccgaaagactctcccgcgccagcagttgcaacctcagctccacttcgtcgtaggtaaacgaggagcagcgtaaactgctacgggagaaagataaaaagcccagcgcccggttcggcaacatcacacactgggttacgcctctgcgtaatccgaaacgctgggcggcatcccacatcgccttcgcttcatgaaatagcacgtcatcccaatgtaaatgaccctgcctgaaattttccggctttaataccggatcgatcgcgaaatagttttcggactggtaatgcgttacccacgccggaggataagtggtacgaagcgatattttaggccgggtaaaggggacgggatgacgaacacacagggcataataatcaaattccagccgctgtgtctgatattgcaattcagtataaacatcctctgctgccgccatctcctgaaagcgtaacaacattgcgcgtcgccaggtgaagaaatcattttcctgcatattttatggtcacgcctttgatattgataatcattattatgaatgacttaaattaacacataaatagtgtttatatataagaaatatcggacgaaacgtagaatacttgagcggcattacactttttggcttccgcctgagagcgaggttaataatctggcagaatgacttcataattattcattgcgctcgcccaaggcgcggctaattcgggcgagcgttgaaaaggcattatttcactaaaaatttctcaaggaactggcgggtacgcggatgctgaggatcggcgaacaaggttttcgccggcccctgctcgacgatttgcccctgatccataaatattgcccgatcagccacgtcacgcgcaaagctcatttcgtgagtaacgatcaccattgtgcgcttttcctgcgccagctggcgaatcgtattaagcacctcgccgactaattcaggatcaagcgccgacgtcggctcatcaaacagaatcacttccgggcgcatcgccagcgcgcgcgcaatcgccacgcgctgctgttgcccgcccgacaggcggcgcggataacgggactctttaccggccaacccgactttggctaacagttcccgcgccagcgccgtcgcctcggctttcggctctccctttacaatcaccggaccttcaatgatattttccagcacggtacgatgcgggaacaggttaaaactctgaaagacaaagccgacatgctggcgtagctggcgaatcaaccctttttgctggctgaatgggcgggcggtatcgatgataatatcgcccactttaatggtgcccgcttccggttgttccagcaggttaatacagcgtaataacgttgtcttccctgagccgctcgggccgataatggcgacgacttctccgggcttcacctcaaggtcaataccgtgcagcaccgtttgaccatgaaattttttgaccaggttggtaacttcgatcgcactcattttggctctctctcctggcggttaagctggttttcaaaatagttttgcagtgccgataagacggtcgccattacccagtagattaacgacgcggccagatacatggtaaacacctccagcgttcgcgaggtaattaactgcgcctggcggaacaactccggcacctgaatcgtcgcggcgagcgacgtatctttcaccaggctgataaagctgttgctcaacggcggaagcgcgacgcgagcggcctgcggcaaaatagcgcgacgtagcgtttgccacggcgtcatgccaatgctcgccgccgcttcccattgtcccttgtcgatagccgagatcgccgcgcgcagcgtctcggacgtgtaagccgcggtattgagcgataaaccaatcatcgccgccgggatagggtccagctcaataccaaattgcggcaggccgtaatagatcataaataactgggcgataagcggcgtaccgcgaaaaatcgagatataaaagcgcgccagccagcgaaccggccatagcggagacatccgcatcagcgccagcacaaatcccagcagcagaccaaaaaacataccgccaatactcagttgcagggtaaagacggcgcctttaagcaaatacggcagcgattcaataaccagttggatactttcttgcattcgcgttgattacctggaggttatacatgaggatggtaggcaaacagcgcaggcgccccaccggtgtgaataaagagaatcggcccgtcatcgttaaagcgtttctggctgatgccgtctatcagacccgccatcgctttaccggtatataccggatccagcagcaccccctccaggctcgccagcagtttcaccgcctccatccccgcgtcatttggcacgccgtaacccggggcaaaatagtcatcccataaatggatatccgccgtcgccgtcagcgccagctgaccggcaatagcctgctgcaaggcaatcactttgggtttctgctcggcgacagaacgtgaaacggtcacgccaatcagttcgacatccggcatcagatgttccagcccgacagctaacccggcgtgcgttccggcgctgccggaggccaccaccaccgaagagagcccgacgacctcttcacactgctgggcgatttccagggcgctctctacgtatcccattgcccccagcgcgctggaaccgccgaccggaatcacatagggcctgaacccttgcgcttcaatgcgcgtcgccagcgtttgcagctgcgcatccggatcggttagcgcatcgcacatctcaatttgcgtattaaataaatccagtaacaggcgattaccattcgtcaggtaattttccgcggtggtaccgattggattttccagcaaggcgacgcaatgcagtcccaatttggccgcgactgccgccgtctgacggacatggttcgactgaatcgcccctgcggttatcagcgtatccgccccttctcgcagcgcgtcggccaccaaaaactccagcttgcgcagtttattgccgcccattgcaatgggcgtaacgtcatcgcgcttaatgtaaatctcacggccaagataatcagacaatcgcggcaggtattcgagcggggtcggcgcgccgataaactccaggcgagggaagcgcgttaagtgatgtagtggcattgagcctccggtaacgttgtggtgtgttctttttattatgcacgttgatctaacggaaataaaaaaggcgccgattcacgcgcctccgtttgctgacatagtatgaggttgatattgcccggtggcgcactgcctgccgggcaacgtagaacattattgggtcacgtcagcgccaaaccatttttcagagagcgcttttaaggtgccatctttttgcatttccgcaatggcgttatctaccgccttcagcaagtcttcgttgcctttacgtaacgcaacgccggactcctgacgcgaaaacgcatcaccggtgacggccagcgtacctttggtttttttcaccagatccagcgccgccagacgatcgactaaaatcgcgtcaatacggcctacgcgcagatcctggtattttgtaggatcatcgtcataggtacggatatccacgccctgcacatgttgacgtagccactcttcatagttagtccccagcccaacgccgacttttttgccctgcagatcggcagccgttttgatcgtgccttcattgccttttttcaccagcgcctgaatgccggagacagtataaggcgtagagaaatcatattttttcttgcggacgtctgaaatcgtgacctggtttatcaccacatcaatacgtttagcgtccagcgacgccagcattccgtcccatttggtcggcttcaacgacgctttaacgcccagatgttttgccaacgcctcggcgaaatcgacttcaaaaccggttaatttgccgtcttcgccctgaaagctaaacggcggataggtaccttccagccctaccagcagcgtgccgcgttctttaactttgttcagcaaaccctcatcggcaaagctcttcgcgctcattcccgccaccagcgctacagccattactcccatcagtgcctgacgtcccagcagtgctaatttcatagtaaccccgaatattgccgttaatgaccatagactgtgtcccgccatggcgcatcgtcacgtctcgcgaacctttgggggactcagcctaatgtagaaggtttgccacgtttcaccaacacgactctgctacatcttatgcttttttaatatatatcagaactggcggtaaagggggatttctgtctgggcgcaatctgctgatgcgctttatattgctggtatttacgcagtgcgatacggtaattattggtgctggtttccggcaaccatggcgccaggctttcatcgagaaaaccgtcctgcagcagatcgtgggaaatgttttgctcgctgaggtaattgccaaggcgtcgtaaacgcacgacatattcccgcaccgtgccatggctcatctcggtttgttcaaacaaatactgcttgaaaccgataatatcgaaaaaatcactctgctttttgcagtgcaaatcgccgcaaaagcgacacagcgccacccactccttctgctcccgctgccaggcagcgtcgtcaagtagcatatccagctgtgaaatagcgattttattaacgatcttgccacggcgaaccagcgtaatgcggtcgagcagtttgtgacaatgcgcgcaatgcgtctggctgtgtttaaagtctttaagatagcggctcaaaggccgccttttaggttgctgcaccgtcatgagaactcctggtagtctatacgttgtgcggcacttttcgggtgcgatcatgcgcgacctataacttacccagtttggtgcgtaatcgtttgatggcctgactatgcaactggctgacccgcgattcgccgacttccagtaccgcgccaatctctttgagattgagctcttcctggtaatacagcgttaacaccagttgctcgcgttccggcagcgattcaatcgcatccattacccgctgtcgcaggtcgccctccagcagttgatgtaacgggttttcctgttgatgttcttcagtcaccagttcgatgctatcgccatgctcttcccgccactcatcgtaagagaaaagttggctgttgttggtatcgagcaacatctgacgatactccgcaacagggatgccaagacgttccgccacttcggtttccgtcgcattacgccccagttcctgctccagttgtcccatcgcctgcgccacttcgcgggcattacgccggacgctacgcggcacccaatcgcggctgcgtaattcatccagcatcgccccacgaatacgctgcactgcgtaagtggtaaatgccgttccttgcaaagcgtcatatcggtcgaccgcatttaataacccgatgccgcccgcttgtagcagatcgtccagttccacgctcgccggcaatcgcacctgcaggcgcaatgcttcgtgacgcaccagcggtacataacgctgccacagcgagtgtttatccattacaccttcagcggtatacagtgaattcacgataaacagccctgcgttaaatgagttatcggcatgattatccgtttctacagagggttctatcgaaggaataaggctataaaagaagggttatttcacttatgtaacctgtagcgcctttttagcggctaaaagagcagaataaaatcagccagatagaataaatatcctccggcatagccggaggtttttcagatgcgcctataaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtgttcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaacgggatgcgcaaaagcccaccccgaacaaaactatgtcagaagatgaatcatcgacagatcgtcgccagtacgcaccgtttctatatggcgatgaaaattcttcgccacctcgctgttatgctggctgcgggagtgaaaactatacacaatattggtaacgtcatcccactctatacgcccgcgctcatgcacgctggctgccgttaatagcttaataaaggcatattccgccacgataatatacagcgcgcgtaacgggtcgacattcggctggttggggaaattattttcccaaattttatagagaattaaatttctgaaggcccagttcttctgctgctcattcgcctgtaaacagcgcgctaatgaggactcaatatcgctaaccttctgctccattgaaacgccctcttccgccgtcagcacccgcagaagacactggatgtagtgatcgaggataacactgccacgattaagcgggagcgagcggaaatagtcctgcatctgcaataccagcgaggtttttaccttgctatccggcgcgatattcattaactcctgcgccagcacgccggtctgcaactgttcaagtaacgcggcatacacctgttccagttcgcccagcgcggcatcatcaattttggcaaatttctgtgcatacatgacgaatttaatcaacgcatagagcgcggcttccgtactgctgttggcatggttgatcagactcaggcaaaacagattgagtaacttttgctgcgctgggaataacggcgcagtattgaatgtctgctgaatgattgttttttcgctgagtgccattgcgtcaggatcgtttaaaatgcgggacgtcacctccgggcaggcaagactcagagagttacgcacctcatttttataggtatgatgcgcccgcgggaaagaggaacaggtatgacttaatgcctttgcgcctaacgttttttgtacccggcacagacggtcctcatccagataagggcaattccccagcgccgaaggcagcttaatttcgccccagtggctgttgttctttttcagcaggataatatggtcttgcgcgatggtacgaatcgtcgtgtctttactggcgagatattttttaaccgtcgtcttatccagcgtgattttccagcccttacaacagtggtcgcgacaggccgagccagaacaggaaaagcgggtgacaaaggcaggttcagtgacggtgatttctttcattacacaggctccggaattaaaaaaggcagctttcgctgccttgattgtgtaccacgtgtcggtgaatcaatcgccggattaacgcagtaaagagaggacgttttgcggaacctggttcgcctgcgccagaacggaggtaccggcctgctgcagaatctgcgcgcgagacatgttggaaacttcggtcgcgtagtcggaatcttcgatacggctacgggcagaagtcaggttgtttacggtgttgcccaggttggtaatagcggagttgaaacggttctgtaccgcacccaggtcagaacgtaacgtgtcaacctgtgccaaagcagcatcaattttctgcagcgggttttcggtggttgtagcagccgcttccgccagatcaggctgtgctttaaagttgtgaccttcggctttacttgcagcgtaagttttaccaccaatagaaacaacttcggttttgccgtctgcgccacccagtttgtttagtgcagttttggatgtaccgtcatctgcagtgtatttcgtagtattaatacttatggaaccatctttattttgagttgcagaatagtaatcatcgcctaccttaactgctaaaccaccatcaatagttttaccgttattatcagtataagacatcttaacaacagatgctgtgccggtaacacctgctgctgtcaatgcggctttagcctctgtcaaatcagcatttgcaacttgtacatttttcacatcctcagttgctgtcgcaggtagtccacctgtaagcggggaagtcgcaccgccagcaagagtcacctcaccgttcgtcttatcaacggaaacttcataatagccatctttaccagttccccccgtaacggtaactttggcgtaatattttccagtcgtatcatcaaattttaaatcgccatcaattttctggtcagtaccaccaagaccagtagccgaggctttaaaagtactattgtctaaagcaatcgtagtatcggcatatcctgtaacagttgcagccgtatcgctgaccttatatttttgttgcacattcagcgtatccagacccagggtctgagagttgatctgcttcagatcgatatcgatagtttcaccgtcgttggcaccaacctggatggtcagggtgttgtcctgcgccaggactttcacgccgttgaactgagtctggccggatacacggtcgatttcgttcaggcgctgggtgatttcagcctggatggagtcgaggtcagactgggagttggtgctgttagcagactgaaccgccagttcacgcacacgctgcaggttgttgttgatttcgttcagcgcgccttcagtggtctgcgcaatggagataccgtcgttagcgttacgggaagcctgagtcagacctttgatgttcgcggtaaaacggttagcaatcgcctgacctgccgcatcgtctttcgcgctgttgatacgcagaccggaagacagacgctcgatagcggtgcccagagcggactgggatttgttcaggttattctgggtcaacagcgacaggctgtttgtattaatgacttgtgccatgatcttttccttatcaattacaacttgatgttattgggctgttgcccacggtttctcaccgtaacccttgtatcggcacctgaatttcgaactttagaaaatttttcacttcccccgatctttttcttaggcggcgaaatagccgctttatgcatcattattccgcgcattatttttgcaaaattatcattaaactttgcctccagattgccgataacgcgcttaactactgtttgcaatcaaaaaggaagaaggcatggcttcaatttcatcattaggtgtgggatcaaacttaccgttagaccagttgttgacagacctgacaaagaacgaaaaaggacgcttaacgccaattaccaaacagcagagcgcgaattcggcaaagctaaccgcctatggcacattgaaaagcgcattagaaaaattccagacggcaaataccgcgttaaataaagcggatttatttaagtctaccgtggcgtccagcaccactgaagatctcaaagtcagtactaccgctggcgctgccgcagggacttataagattaacgtaacccagcttgccgccgcacagtcgctggcgacaaaaaccaccttcgcgaccaccaaagagcagttgggcgatacgtcggtcacgtcccggacaattaaaattgaacagccgggacgtaaagagccgctggaaattaagctggataaaggcgacacctccatggaggcgatccgtgacgccatcaatgacgccgacagcggtatcgccgccagtatcgttaaggtcaaagagaacgaattccagttggtgcttaccgccaatagcggtaccgacaatacgatgaagatcacggtggaaggcgatacaaaacttaacgatctactcgcttatgacagcaccaccaataccggcaatatgcaagagctggtgaaagcagaaaacgcgaagctgaacgtaaacggcatcgacattgagcgtcagagcaataccgtaaccgacgcccctcagggaattacgctcaccctgaccaagaaagtgaccgacgcgaccgtgacggtaacgaaagatgataccaaggcgaaagaggcgattaaatcctgggtggatgcctataactcgctggtggatacctttagctcgttaaccaaatataccgccgttgagccgggcgaagaagccagcgataaaaacggcgcgctgttaggcgatagtgtggttcgtactatccagaccgggattcgggcacaatttgccaatagcggcagtaattctgcgttcaaaacaatggcggaaattggcatcacccaggatgggacttccggcaaactgaagattgatgatgataagctgaccaaagtactgaaagataacacagccgcagcgcgtgagctgctggtaggcgatggtaaagaaacgggtatcaccaccaaaattgccaccgaagtgaaaagttatctggcggatgacggcattattgataatgcgcaggacaacgttaacgccacgctgaaaagcctgacaaaacagtacctgtccgttagcaacagcatcgatgaaaccgttgcccgttacaaggcccagtttacccaactggataccatgatgagtaagctgaataacaccagtagttatttgacccagcaatttacagctatgaacaagtcctgataacagaggtcaccatgtacaccgcgagcggtatcaaagcttatgcgcaagtcagcgtggaaagcgccgtgatgagcgccagcccgcatcagttgattgaaatgttgtttgatggcgcgaatagcgctctggtgcgcgctcgcctgtttttagaacaaggcgatgttgtcgcgaaaggtgaagcgttaagcaaagccatcaatattatcgataacgggctgaaagccggcctcgatcaggaaaaaggcggtgagattgcgacgaatctttccgagctatacgactatatgattcgccgtttactgcaggctaatttgcgtaacgacgctcaggccatcgaagaagtggaagggttactcagcaatattgcagaagcctggaagcagatttcaccgaaagcatctttccaggagtctcgttaatgacctcaaccgtggagtttatcaaccgttggcagcgtattgcgctgctcagtcaatcgctgcttgaacttgcgcagcgaggtgaatgggatctcttactgcaacaagaggtctcctatctgcaaagtattgaaacggtgatggaaaagcaaactccaccgggcattacgcgaagtattcaggatatggtcgccggatacatcaaacaaacgctggacaatgagcagctcctgaaagggctgctgcaacagcgactggatgaactgagtagtttgatcggacaatccacccgccaaaaatcactcaacaacgcgtatggccgtctttccggtatgttactcgtgccagatgcgcctggcgcctcataatattttcccgtctcgtatgaaaattcttccatactccagaggtcggctaaacgacttctggagcacggaagatgaaaaaccccacgttattgcagtacttccactggtattatcccgacggcggtaaactctggtctgagctggcggaacgtgctgatgggctgaatgatatcggtatcaatatggtctggctaccgcccgcctgtaaaggcgcctccggcggctattccgtaggctatgatacctacgacctgtttgacctcggcgaatttgaccaaaaaggaactatcgcgacaaagtacggcgataaacgccagttactgacggcgatagacgcgctcaaaaaaaataatattgcggtgctgctcgacgtcgtcgtgaaccacaaaatgggcgcagacgaaaaagaacgtattcgcgttcagcgcgtgaatcaggatgaccgcacgcaaatcgatgacaacatcattgaatgcgaaggctggacgcgctacaccttccctgcccgcgcgggccagtattccaactttatttgggactatcactgtttcagcggcattgatcacatcgagaatcccgacgaagacggcatttttaagatcgtcaatgactataccggcgatggctggaacgatcaggttgatgatgagatgggtaatttcgactatctgatgggtgaaaatatcgattttcgcaatcatgcggttacggaagagattaaatattgggctcgttgggtcatggaacaaacccactgtgacggctttcgcctggacgcggtaaaacatatacccgcctggttttataaagaatggattgagcatgtacaggcggttgcgccaaaaccgctgtttattgtcgcagaatactggtcgcatgaagtggataaactgcaaacgtacatcgatcaggtcgacgggaaaaccatgctgttcgacgcgccgttgcagatgaaatttcacgaggcctcgcgccagggcgcggagtatgacatgcgccacattttcaccggcacgctggtagaagccgacccttttcatgcggtgacgctggtcgctaaccacgatacacaaccgttacaggcgctggaagcgccggtagaaccctggttcaaaccattggcctatgcgctgatcctgcttcgtgaaaacggcgtgccgtcagtgttttatcccgatttatacggcgccagctatgaggatagcggcgaaaatggcgagacctgtcgggtcgacatgccggtgattaaccaactggatcggctgatcctcgctcgtcagcgttttgcgcacggtatacaaacactctttttcgatcatcctaactgtatcgcctttagtcgcagcggtactgaagagaatccaggctgtgtggtcgtactttccaatggcgacgacggtgaaaaaaccctcctgctcggcgacaattacgctaacaagacctggcgtgattttctgggaaaccgggatgagtatgttgtaactaatgatcaaggcgaagcgacgttcttctgcaacgcaggcagcgtcagcgtgtgggtcattgaggacgtgtgatgagcgttcccggcggcagagcgctgccgggaagcgaaattacggcagcggcgtcggcagcggcgtcggcagcggcgttttttctaacgcggcggcgcactccggcgtcggacgagcgacccgttgcagcgtcatgccatcatattccagggtattcccgtcgcgctcaatctcatagagctcacgcttaaccgtaacattggttaagtcatcggagagcatggtcagcttgcccggcagagcaataacgcgctgccactggcggcagtccagcgtatcgccttctttagtcaccaccaggctggcgatagcttcagggctcaccagcttacgttgcgggccttttgactgccagtacccttccagaccggccggcgcgggcgttttcaccacatcattatagttttccacctcggcgcatccggccagaaccagcaatgcgccaacgatcgctacttttttcatcattcatcctgcatcagaagaaagaagaattgtggcattaaagccctgacgccgccagcctttccaggcgctggccgcaatttgatccagtcggtattaccgcttattaggtgtaggcaaattctgtgatcggtgtagtatgcgcacttcttgtttcacaccttctgagttcagaggctaaacacatgtcatggcaacacttcaagcaaacctggttaattaaattctgggcgccggcccctgcggtgatcgcagccggtattctctctacctactattttggcatcaccggcacgttttgggccgtgacgggcgaatttacccgctggggcgggcaaattttgcagctttttggcgttcatgccgaacagtggggctactacaagctgattcatctggaaggtacgccgctgacgcgtatcgacggcatgatgatcctcggcatgttcggcggctgtttcgccgcggcgctgtgggccaacaacgtaaaactgcgtatgccgcgcagccgaatccgtatcgtacaggcggtggccggaggcattatcgctggcttcggcgcgcgtctggcgatggggtgtaacctggccgccttttttaccgggatcccgcagttctccctacacgcgtggttctttgcgctggcgaccgctatcggctcctggttcggcgcccgctttacgttgctgccgatatttcgcataccggtgaaaatgcagaaggtctccgcggcttcgccactgacgcagaaaccggatcaggcaagacggcgtttcaggctcggtatgctggtctttatcggcatgattggctgggcgttattaacggcaatgcatcagccgaaactggggctggcgatgctgttcggcgtcgggtttgggctgctgatcgaacgcgcgcaaatctgctttacctcggcctttcgcgatctgtggatctccggacgcgcccatatggcgaaagcgattattttcggcatggcggtcagcgccattggtattttcagctacgtgcagttgggcgttgcacctaaaattatgtgggctggcccgaatgcggtcattggcggactgctgttcggttttggcatcgtgctggcgggcggctgcgaaaccggctggatgtaccgcgccgtagaaggccaggtgcattactggtgggtaggcctcggcaatgtcatcggttcgaccatcctggcttactactgggatgatttcgcgcccgcgctggcgaccagttgggataaagttaacctgctgaatacctttggtccgctgggcggtctgctggtcacctatctgttgttatttaccgcgctgatgttaatcatcggctgggaaaaacgttttttccgccgtgcggggctgacgcctgctaaggaatctgtatgaaaaatatcgtccctgattaccgtctggatatggttggcgaaccttgcccgtacccggcggtcgccactctggaagcgatgccgcagctaaaaaaaggtgagatcctggaagtggtgagcgactgtccgcaatccattaataatattccactggatgcgcgcaatcacggctatacggtgctggatatccaacaggatggcccgacaattcgttatctgattcaaaaataagcgcatactcccgctgtacgttacggcgggagaccttttacggcataaccggcaaaaatctacaacgcataaaagaaatcagacaaggtcgtcttgtgcgccgtggcataaatctattatataacgtataccgttttaattctgtctgagccgatgaaaaatccagggttattttaatcaaaacataaaacaattattattttccgtctacgccataaaagactatcaggtatttatatttttactcactgacatcatcaggtgatgatttatttatgcacagcagaagccaaaaaaatgataaaaattattttcatctccattattggagtcgtctgtcttgccgctgcccgttattcacccgtcacagtggtcaatgcacatccgagcgccattgcccgctgtctcgctgataatctgtccccgtatgggtatatactggatctccatgaaacagatattccaggcattaataaagaatttaccgtgtattatcgcaacggcgcatatattgcaggaacattctggattgcaaactcaatgacaatagcatcagaacgaatagtaggaatgaatggcgttagtaaacaggcgtaccctatttttaataaatccctgcaacaatgtgcaacccgcttatcaataaaatgagcgcgcctcgcaaaaataagcccacataatcacgcactggttgcatgggcgtcgcgtcccccgccgctgacgtaggtaagcgcccgggagttcgctgcggatgtgttgtcagccctggcttaaacctgcatggacatgacttcctgatacgcggcgaccagcttgttgcgcacctgaatccccatttgcatagagacggacgctttttgcatatcggccatcacgtcattaagcgcaatgcccggctcacccagagtgaatttttccgcctgaacgcgcgccgccgcttgtctgtcgctaatacgatccagcgcagcatgtagctggccggcaaaactcaccgtcgactgcgagtgcgtgtcttgcccgcgcgcggccatcgccgtcgcctgtaactggctaataaccccttcaatcccctgtattgctgccatgctattcccctggatgattttttacgcagcagagattaccagtttgtcaataagataaaggcgttaaataacgataaaaaacctcggtttttagcgcatagaaaaattcgaaaccacaaataatgagaccgtcaatttttcgagtttgctgacccgggagtgagtcttgttccactttgcaaaaaacgccgtccacgatcagtcacgaggtgcgagatgagtgcgactgcatcgactgcaacccaacctaaacctctcgagtggcttaatcgcctacgcgcgaatccccgaattccgttaattgtggcgggttccgctgccgtggcgatcgtcgttgcgatggtgctgtgggccaaaacgcccgattaccgcacgctatttagcaacctttccgatcaggacggcggcgcgatcgtcgcgcagttgacccagatgaatatcccctatcgctttgccaatggcagcggcgcgattgaagtgcccgccgacaaagtgcatgaactgcgtctgcgtctggcgcagcaggggctgcctaaaggcggcgcggtaggctttgaactgcttgatcaggaaaaattcggtatcagccagttcagcgagcaggtgaattatcagcgcgcgctggaaggtgaactggcccggacgatcgagacgctggggccggtaaaaagcgcccgcgttcacctggcgatgccaaagccgtcgctatttgtgcgggaacaaaaatccccttccgcctccgtcaccgtcacactggaaccgggacgggcgctggatgaaggacaaattagcgccgtggtacatctggtttccagcgctgtcgccggtttgccgccaggaaacgtcactctggtcgatcaatccggtcatctgctcacgcaatccaataccagcggtcgcgaccttaatgacgcgcaattaaaatttgctaatgatgtggaaagccgtatccaacgccgtatcgaagccattctgtcgcctatcgtcgggaacggtaatgttcacgctcaggtaaccgcccagttggattttgccaataaagagcagacggaagagcactacagcccgaacggcgatgcgtcgaaggccactctgcgttcacgtcagttgaatattagcgaacaggtaggcgcgggctatcccggcggcgtgcctggcgcgctgtcgaaccaaccagcgccgcctaacgaggcgccgatcgccacgccgccgaccaatcaacaaaacgcgcagaatacgccacaaaccagcaccagtaccaacagtaacagtgctggcccgcgtagtacacagcgtaatgaaaccagtaactacgaagtggaccgcaccattcgtcacaccaaaatgaatgtgggcgatattgagcgtctctccgtggccgtcgtggtgaattacaaaacgctggcggatggcaaaccgctgccattgaccgccgatcagatgaaacagatcgaggatttaacccgtgaagcgatgggtttttctgataaacgcggcgatacgctaaatgtggtgaattcaccgtttagcgcagtggataacaccggcggcgaactgcccttctggcaacagcagtcctttatcgatcagttgctcgcggcaggtcgctggttgctggtgctggtggtggcctggattctgtggcgcaaagcggtacgtccgcagttgacgcgccgcgttgaagaagcgaaagcggcgcaggaacaggcgcaggttcgccaggaaaccgaagaagccgtggaagtacgccttagcaaagacgagcagctccagcaacgccgggctaaccagcgtctgggcgctgaggtgatgagccagcgtattcgcgaaatgtcagacaacgatccgcgcgtggtggcgctggtcattcgccagtggatgagtaacgatcatgagtaatcttagcggtaccgataaaagcgtcattttgttgatgaccattggcgaagaccgggcggcagaggtgtttaaacacctctccacccgcgaagtacaggcgttaagtacggcgatggctaacgtgcgtcagatctccaacaaacaactgacggacgtactatcagagtttgagcaagaagcggagcagttcgccgcgctgaatatcaacgccaacgaatacctgcgctccgtactggttaaagcgctgggcgaagaacgcgcctccagcctgctggaagatattctggaaacgcgcgataccaccagcggtatcgaaacgctcaactttatggaaccgcagagtgccgccgacctgattcgcgacgaacacccgcagattatcgccaccattctggtccacctcaaacgcagtcaggccgccgatattctggcgctgtttgacgagcgtctgcgtcatgatgtgatgctgcgtatcgcgacatttggcggcgtacagccggcggcgctggcggagttgaccgaagtgctgaatggcctgctcgatggtcagaacctgaaacgcagcaaaatgggtggcgtaagaaccgcggcggaaattatcaacctgatgaaaacgcagcaggaagaagcggttattaccgctgtgcgcgaattcgacggcgaactggcgcagaaaatcatcgacgagatgttcctgttcgaaaatctggtggatgtggacgatcgcagtatccagcgtctgctgcaggaagtggattccgaatcgctgctgatcgctctgaaaggcgccgaaccgccattacgcgagaagttcctgcgcaatatgtcccagcgcgccgccgatatcctgcgcgacgaccttgccaaccgtggcccggttcgtctgtctcaggtggaaaacgagcagaaagcgattctgcttattgtgcgtcgtctggcggaaaccggcgaaatggtgattggcagcggcgaggatacctatgtctaatgaattgccgtggcaagtctggacccccgacgatctcgccccgccgccagaaacttttgtgccggttgaggctgataacgtgaccttgacagaagatacgccggagcccgaactcactgccgaacagcagctggagcaggagctggcgcagctaaaaatacaggcccatgaacaaggttataacgccgggctggcggagggacggcaaaaaggacacgcgcagggataccaggaagggttagcgcaggggctggagcaaggacaagcccaggcgcagacgcagcaggcgccgattcatgcccgtatgcagcagttagtgagcgagtttcagaacacgcttgacgcgctcgatagcgttatcgcctcacggctgatgcaaatggccctggaggccgcacgtcaggtcatcggccaaacgccggcggtggacaactcagcgctgattaaacagatccaacaactgttgcagcaagagccgctctttagcggcaagccgcagttgcgcgtgcatccggacgacttacagcgggtggaagagatgctgggcgccacgctcagtcttcacggatggcggttacgcggcgatccaacgttgcatcacggcgggtgtaaagtctctgccgatgagggcgatctggacgccagcgtcgccactcgctggcaagagttgtgtcgcctggcggcgccgggagtgctctgatgaccacgcgcctgacccgctggcttaccgcgctcgacaactttgaagccaaaatggcgttattgccggcggtgcgtcgttatggacgtttaacccgcgccactggcctggtactggaggccaccggtctccagcttccgctgggcgccacctgcattattgagcgccaggacggccctgaaaccaaagaggtggaatcagaagtcgtcggttttaacggccagcgtctgtttctaatgccgctggaagaggtcgaaggcattctgcccggtgcccgcgtttacgcccgtaacgggcatggcgacggtctgcaaagcggcaaacagttaccgctcggcccggccctgcttggtcgggtgctggatggcggcggtaaaccgctcgacggactgcctgcgccggatacgctggaaaccggcgcgttaatcacgccgccgtttaacccgctacagcgaacgccaatcgaacatgtgctggataccggcgtacgcgctatcaacgcgttgttaaccgtagggcgcggtcagcgtatgggactctttgccggttccggcgttggtaaatcggttctgcttggcatgatggcgcgctacacgcgggcggacgtgattgtcgtgggacttatcggcgaacgtggccgcgaagttaaagattttatcgaaaatattctcggccccgacggtcgcgcgcgttcggtggtgatcgccgccccggcggatgtctcgccgctgctgcgaatgcagggcgccgcctatgccacccgcatcgccgaagactttcgcgatcgcggacagcatgtgttgctgattatggattcgctgacgcgctatgcaatggcgcagcgtgagattgcgctggcaatcggcgaaccgccagccaccaaaggttatccgccctcggtgttcgcaaagctgccggcgctggtcgagcgtgccggtaatggcatccacggcggtggctctatcaccgcgttttataccgtgttgaccgagggggacgaccaacaagatcccattgccgactcggcacgcgcaatcctcgacgggcacattgtcttgtcccgccgtctggcggaggccgggcactatccggccattgatatcgaggcgtcaatcagccgggcgatgaccgcgctcattaccgagcagcactatgcgcgggtacggctatttaaacagttgctttccagtttccagcgtaaccgcgatctggtcagcgtcggcgcctatgccaaaggcagcgatccgatgctcgataaagccattaccttatggccgcaactggaagcgtttttacagcaaggcatttttgaacgggccgactgggaggactctctgcaggcgctcgatttaattttcccgacggtgtgataaagcaggagggcgacgatcatggcacaacatggcgctctggaaacactcaaagatctggccgaaaaagaggtagatgacgcggcgcgtttactgggcgaaatgcgtcgcggctgccaacaggcggaagaacagctcaaaatgctgatcgattatcagaatgagtatcgcagtaatttgaacaccgatatgggcaacggcatcgccagtaatcgctggatcaactatcagcagtttattcagacactggaaaaggcgatagagcagcatcgcctccagcttacgcagtggacgcaaaaagtcgacctggcgctgaagagctggcgtgagaaaaagcagcgacttcaggcctggcaaaccttacaggaccgacaaaccgcggcagcgctgttagctgaaaaccgcatggatcagaaaaagatggatgaatttgctcagcgtgcagcaatgaggaaacccgaatgatcaccctgccccaactgatcaccaccgataccgacatgaccgcgggtctgacgtcaggaaaaaccaccggttcagccgaggactttctggcgctcctggcgggcgcgttaggcgcagacggcgcacagggcaaagacgcccgcatcacgctggccgatttacaggcggcaggcggcaagttatcgaaagagctactgacccaacatggcgagccgggccaggcggtgaagcttgccgacctgctggcgcaaaaagcgaatgcgacggatgaaacgcttaccgatctgacacaagcgcagcatctactgtctacgctaacgccatcgttgaaaaccagcgctctggccgcactgagtaagacggcgcagcatgatgagaaaacgcccgcgctgagcgatgaggatcttgccagtctgagcgccttattcgccatgctgcccggacaacctgtcgcgacgcctgtcgccggagaaacgccggctgaaaatcacatcgccttgccgtcactgttacgcggcgacatgccatcggcgccgcaggaagagacacatacgctctcttttagcgagcatgaaaaagggaaaaccgaggcgtcgcttgcgcgcgccagcgacgatcgcgccacggggccagcactgacgccgctggtagtcgctgccgccgcgaccagcgcgaaagtggaggtggatagcccgcccgcgccagtaacgcatggcgcggcaatgccgacgctcagcagcgccacggcgcaaccgctacctgtcgcctcagccccggtactcagcgcgccgttaggcagccatgaatggcagcaaacgttcagtcagcaggtcatgttatttacgcgtcagggacagcaaagcgcgcagcttcgattgcatccggaagagttaggtcaggtgcatatttcgctcaagctggatgacaatcaggcgcagctccagatggtatcgccgcacagccatgtccgcgccgcgctggaagccgccctgcccatgttgcgcacccagttggcggaaagcggcattcagttgggacaaagcagtatcagtagcgaaagctttgccggacagcagcagtcttcgtcgcaacaacagtcttcccgcgcccaacacacggacgcgtttggcgctgaagatgacatagcgttagcggcgccggcctcgcttcaggccgccgcgcgcggcaatggcgcagtggatatcttcgcctaacgccagaggtagcatgattatccgcgtcttttccacgctttgtcgtggacaggacacgggataatcagccaataagcagtaccgaaacaggaagcccgtatcagatgactgactccgcgattaacaaaaagagcaaacgctcgatttggatacctttgctggtgttgattaccctcgccgcctgcgcgaccgccggttatagctactggcgtatgcagcagcaaccgaccacgaacgctaaagcggaaccggctccgccgcccgcgccggtattttttgcgctggatacgtttaccgtcaatctgggcgatgcggatcgcgtgttgtatatcggcgtgaccctgcgtctgaaagacgaagcgacgcgcgcgcgattaaatgaatatctgccggaagtgcgcagccgtctgctgttgttgttttcccgtcagaatgccgccgagctctcaacagaagctggcaaacaaaaactgattgccgccattaaagagacactggccgcgccgctcgttgccggacaaccaaaacaggtcgtcactgacgtgctttatacagcttttattctgcggtaacgatatgggcgatagtattctttctcaggctgaaatcgatgcgctgttgaacggcgacagcgacaccaaagacgaacccactcccggtatcgcaagcgatagcgatattcgcccttacgatcccaatacccagcgtcgcgtcgtgcgtgaacgcttgcaggcgctggagattattaacgagcgtttcgcacgccagttccggatgggattatttaacctgctgcgccgcagcccggatattaccgtgggtgccatacgtattcagccgtatcacgaatttgcgcgtaacctgccggtaccgaccaacctgaacctgatccacctgaagccgctacgcggcaccgggctggtggtgttctcgccgagtctggtgtttattgccgtcgataacctgttcggcggcgacggccgttttccgaccaaagtcgagggccgcgagtttacccatacggaacagcgtgtcatcaaccgtatgctgaaactggcgctggaaggctatagcgacgcatggaaagccattaatccgctggaagtggagtatgtgcgttccgaaatgcaggtgaaatttaccaatatcaccacctcgccgaacgatatcgtcgtcaatacgccgtttcatgtggagatcggcaatctgaccggtgaatttaacatctgtctgccatttagcatgatcgagccgctgcgtgagctgctggtgaatccgccgctggaaaactcgcgccatgaagatcagaactggcgtgataacctggtgcgccaggttcagcactctgaactggagctggtggccaattttgccgatattccgttacgtctttcccagattttgaagctgaaacccggcgatgtactgccgattgaaaaacccgaccgcattattgctcatgtggacggcgttccggtactcaccagccaatatggcaccgtaaacggacagtatgcgctacgcgtagaacatttgatcaacccaattttgaattcgctgaatgaggaacagcccaaatgagtgacatgaataatccgtccgatgagaatactggcgcattggatgatctgtgggctgacgcgttaaacgagcaaaaagcgaccaccactaaaagcgccgccgacgcggttttccaacagcttggcggcggcgatgtcagcggtgctatgcaggatatcgatctgattatggatatcccggtcaaactgaccgtagagctgggccgcacgcgaatgaccattaaagaactgctgcgtctgacgcaggggtcggtcgtcgcgctggacgggctggcgggcgagccgctggatatcctgattaatggctacctgattgcccagggtgaagtggtcgtcgtggcggataaatacggcgtacgtatcaccgatattattacgccatccgagcgtatgcgtcgtttgagtcgttaatgatgaagacagaagccacggtttctcagcccaccgcgccagccggatcgccgctcatgcaggtgagcggcgcattaattggcattattgcgctcattctggcggcggcctgggtgattaagcgtatgggattcgcgccaaaaggaaatagcgtccggggactgaaggtgtcagccagcgcctcgcttggcccgcgcgaacgcgtggtgattgtcgaggtcgaaaatgcgcgcctggtactgggcgtgaccgcctcgcagatcaacctgctgcacaccctgccgcccgcggagaatgacacggaagcacccgttgccccaccggcggatttccagaacatgatgaagagcttactcaagcgttccgggagatcctgatgcgccgtttgttattcctttctctggcgggtctgtggctttttagtcccgccgccgctgcgcaactgccggggcttatcagccaaccattagcgggcggaggccaaagctggtcattatccgtccagacgctggttttcatcacctcgctgacgtttctgccggcgattttactgatgatgacgagcttcacgcgtatcatcattgtttttggcctgttgcgtaacgcgctgggcacgccctcggcaccgccaaatcaggtgttactcgggctggcgttgtttttgaccttttttattatgtcgcccgtcattgacaagatttacgtggatgcttaccagccgtttagcgagcagaaaatttctatgcaggaagcgctggataaaggcgcgcaaccgttacgcgcgttcatgctgcgccaaacccgcgaagccgatctggcgctgtttgcccgtctggccaatagcggtccgttacagggaccggaagcagtaccgatgcgtatcctcctgcccgcttatgtcaccagcgaattaaagacggcgtttcagatcggttttacgattttcatcccttttttgattatcgacctggtgatcgccagcgtattgatggcgttggggatgatgatggtgccgccagcgacaatcgccctaccgtttaagctgatgctgtttgtgctggtcgatggttggcaattgcttatggggtcgctggcccaaagcttttacagttagaggcgcaaaatgactcctgaatccgtcatgatgatgggcaccgaggcgatgaaagtcgctctcgccctggctgcgccgctgttactcgtcgcgctgattaccggcctcattatcagcatcttgcaggccgcgactcagattaatgaaatgacgctgtcgtttatccctaaaatcgtcgcggtattcatcgcaattatcgttgccggcccgtggatgctcaacctgctgctggattacgtgcgcactctgttcagcaatttaccttatatcatcggataaacagaacgatgatccaggttacaagcgagcaatggctatactggctgcatctctatttctggcctttgctgcgcgtactggcgctgatttcaacggcgcccattctcagcgagcgcgctattcccaagcgggtaaaactggggttgggaataatgattacccttgttatcgcgccgtcgctaccggcaaacgatacgccgcttttttctattgccgccttatggctggcgatgcaacaaattctgatcggtattgcgctgggatttaccatgcaattcgcctttgcggcggtgcgtaccgcaggtgagtttatcggtctgcaaatggggctttcctttgccaccttcgtcgacccgggcagccacctgaatatgccggttctggcgcgtattatggatatgctcgccatgctactgtttctcacctttaatggccatttgtggcttatttcgctgctggtcgataccttccacaccctgcccatcggtagtaacccggtgaacagtaatgcatttatggcgctcgccagggccggagggctcattttcttaaacggactgatgctggcattgccggtcattaccctcctgcttacgctcaacctggcgctggggctattaaaccgcatggcgccgcagctctcgatatttgttatcggtttcccgcttaccctcaccgtcggcattatgctgatggccgcgctaatgccattaattgcgccgttttgcgaacatttattcagcgaaattttcaatttgcttgctgatattgttagcgagatgccgataaataataacccataatttttatcctgttttactaaggtttatccgaaaataaattttaaaaaacattcaccaggatatatccactgccccttatttgtttttacttcactcacataacgcaacattcactttactttaagatgattcctggcaaattatatgtaactttacgggatagtaagttcgcctgaaaaaccgcgtaagcgttgtctaaggtgactattcgtgttccgtctgattatggtgagttattcaggtaaggggaattatcgttacgcattgagtgagggtatgccatgtcaacgattattatggatttgtgcagttacacccggctagggttaagcgggtatctggtcagcagaggggtgaaaaaaagggaaatcaacgacatcgaaaccgttgacgaactcgctatcgcttgtggcgcgcatcagccttcggtggtgtttattaatgaggactgtttcattcatacgccttcagacagtcaacaaataaagcaaatcattaatcaacatcctgacacgttatttattgtttttatggcaattgctaatgtgcattttgatgaatatttattagtaagaaaaaacttattgattagctcgaaatcgattaaacctgactcgctggatacccttcttggcgatattctgaaaaaagagtcgggtatttcaggaaccataaatttaccaacattatcgttaagtcgaactgaatccagcatgttgcgaatgtggatggaaggtcagggaaccattcagatttctgacagaatgaatattaaagcaaaaacagtatcctcccataaggggaatataaaaagaaagataaaaacgcataataaacaagtgatctatcacgtagtacggctgacagataacgtcactaacggcatttttgttaacatgcgctgagacatccggactggcaatgtacctccagtccggctcaattagtcctgctccgccttctcgacaaaaataccatcctggtgacctgactcattgaagaaccagatgccgagcgggtaatcctccagcgaaaccaggtacattgtgccttcactaaattcttccactgccagtaccacgcccggtcggcggggaccgccgtccgttttaacggttacccgatcattcaccttcatcattttcctcctgtcgctttgtgccagtgtagaacaattttctgcgtctgacagcgccttgccggcgtgtttgctggttttctcaacggtctatacttaggctgtcaggaacccgtgaggtggtgaagatgaaaacggcaaaagagtacagtgatacggccaagcgcgaagtgagcgtcgatgtagatgcgctactggcggccatcaatgaaatcagcgaaagcgaggttcaccgtagccaggaagatcctgagcgggtgagcgtagacggacgggaatatcatacatggcatgaattagctgaagcattcgagctggatattcatgattttagtgtaacagaagtaaaccgttaaaaatggccgaaaaaaatcccggccctacgggtcgggatcaaacttgcttatgcaagaagcacttgaaaattcgttacaccaggaaatctgatgtgagatttaccttatctgcaatttttttgcatgacaagtaaatattttttacatgaatgattaagcacgctaatagttcggtagcaaaagtgtgacaacgcatgtgctgcctggaagcgacgggatcggttccagttagcgttcgacttctttcgggtgtgctttaggacttttcctggaaataagcccgccgttgcaacggaaaatgaggaaaaaatgctctcaatccatgaccccttgctgatttttaccgatctggacggcacattgctgaacagccacacttttgagtggcagcccgcggccccctggcttacacgcctgcatgaaagcggcgtgcccgtgatcctctgtagcagtaaaaccgcggctgaaatgctccagctccagacgacgttaaatctacagggactgccgctgattgcggaaaacggcgcagtgatccaactggacgttcattgggaagaccatcccaactatccccgtctgatagccggtatttctcacaacgaaatccgcctcgtcctgcataagttgcgtgaaaaggaacagtttaagttcaccacgtttgatgacgttgacgatcaggtgataagcgaatggacgggcctaaaccgggcacagtctgccctaacccgtctgcatgaagcgtcggtgtcgctgatctggcgcgatagcgatgaacgcatggcgcagtttgtcgcccgtttaaatgacctgggactgcaatttgtccatggcgcccgtttctggcatgtgctggacgcctccgccggtaaagatcaggctgccaattggctgattgaagcatatcgtcggcagtggcgcgcgcgtcctctgacgttggggctaggagacggccccaatgatgcgcccttactggatgtgatggattatgcggttgtcgttaaagggctaaaccgggagggcgtacatttgcgtaacgacgatcctcagcgcgtctaccgtagccagaacgaagggccggatggctggcgcgaaggaatggactatttcttttcccgctcctgagtcgcgtcgctggcgcaaatacggttacgtccggactgtttggcgtaataaagccgtttgtcggccagcgactgcaactgctcaaaatcatagtcgccgtattcctccgcgctactgatccccattgacgcgctgatacgaagcgtcgtgcttttcgtcaccagaatctctttgtcattaatgcgctggcgtatgcgttcggcaatctgcagcgcctgcgctttcgtcgcgccgggcagcacgatacaaaactcttcgccccctacccgtccggcgatgtcgtgcgctcgaatggtgctgccaatgagcccagcggcatgggacaacacgcgatcgcctgcctgatgaccaaagcgatcgttaacgcttttaaaataatctaaatccagctgtatcacagaaaatggctggcgggcttcccggtagcgctttgccagcctggacgctttttcaaacagcgcgccacggttatatagccgggtcagcggatcgtgccatgcctgccattgcagcgaattttgcagaacaaacatgtttttgaccatatgtcgaataacgccccaggagatcaacagcatcgccgtaaaaagcccccataacagcgtcagcgcgatactaatgctgccaaaattcccttgtatgccttcacgtaatgtatgcacgcgcagcaggatgccatcaaaatgatccagccgctcccagcttacataatgcgttcctaaacgcagcccgcccagggtatctttttctatttcacgcgccagtaaggcgcgctcacggtcatttaacgtattcgcggtttgttgttccggcgcggagtccgtcaacaaacggagatggttatcgtatagctgatattccccttcaatatccttttcggccgcatcgcgcaggaaccgctgtaatgacgcgacgggaatatccattgccagtacgccataccagtaattatcgtgatccagcggtagactggctgtcacttttttctgctcgtcagtaacatagggctgtgcggaggtaaaccaccgcacgccgcgctgtgagttacgccgttggctttgctcgataaaccatggctgagtcacgtactgatagtaacgggagacaatatcgctaccgtacgccgtagggagagttgagaggtaaaaccctgagcgagaaacatacatcgtctccagcgccagcatggctgatgagcgcgccagacgcgccagataccctaactccagcgtggcggttaattcatttgccaggtcacgactctcccgcgaaagaagcgtcgtccgggcgacaaattgatcggaaacgccatataacggcaatgtccgccgcttatccaactccaattgccagaaatgtctgacgcgtcgttgctcaaactgcgtcaccgcgctttgcaatgcggaaaaagccagcggcgccaccagcgcttcatgcataccgttgcgtaaaaagatcaacctgtccatgttgaattgcagttggcggtcaaggacattcgcgacgctccccagatgattgcgctgactggcgacatacgcgtctttcagtatcatcacttccctccaggtaagtagcgtcgagaacagcatcacgatcagaaaacaggtgttgacgacatgaccgggaccaaaacgccgcgccagctttttaaaccagccttgattgtctaacagtgtttcgtgcggcaccctggtaactcctggttattgatacaactccccctgatggcttacggtagccagacctcatcaagggataccactcaatcctggcataaccaggtagcagcatgtcgcagcgcgacgactctttttctccacagcaaaacgcccggcattaaccgggcgttttgtcatcgggcttcgtcccgcacgcgcctttccttgcctggcacgagctcattctcatggaatgcctcccgctttacgccaaaaccatcataccagcgacactctaccattccgctggaataaccggtgacgatcatccggggcccaccctctttcacggtaacttcctcactgacagaaaagaccatacctgcctcctgtatcagatgaaacgctttcaccttagacgaggatggacaattttgcataattcattgtagaaaatcagtgcgaaacaccgcgaattttcgccacacctttcaccagcgccaccacaatggcgccgataataaagccgagcaccagattcagccccgcagggatcgtatgcgccatgaaagccccctgctgctgcgcaaaatgttcaatggcatggtgtagcggcgcaataccgtgtacgacaattccgccgccaaccagaaacatcgccagcgtaccgacaatggataatgctttcattaaccagggcgcgataatcagtaatcctttaccgacgccctgcgccagcacgctacgcttttccgccagccagtaccccatatcatccagtttgacaataatacccaccaggccatacacgccaatggtcacaaccaacgcaatccccgccagtaccaacacctgattaagcagcggcgcctgcgcgacaatccccagggtaatggccacaatttcagcggacagaatgaaatcggtacggaccgccccttttactttatctttttcaaaggccaaagggttttgcgcagccagcgcctcaagacgtttttgccgctccgccgggtcttctttgtgttttcgcgcctcaaaggtatgcaggactttttctaccccttcaaagcagagaaacgcgccgcctaacattaataaaggcgtaatggcccacgggataaatgcgcttatcaacagcgccaacggcaccagaataaccttgttgattaatgatcctttcgccacgctccataccaccggcagctcgcgattagcgcgaacgccggtcacctgctgcgcattgagcgacaggtcatcccccagtacgcccgcggtttttttcgcggccaatttgcccattaccgaaatatcgtccagcagcgtggcgatatcgtcgagtaatgtcagtaagctacttcctgccaaaatgatttcctcggtcttttcttctaagacgttaagtatgtagcaaaacgcgcaatgccgaaaccggcggcgcgggtcaacgcctttttattccaaaaggacaattataatgctcgccagcataataattttgacgtttactatattcaccctttttatttcaccgtgagtgattatgcgtttccggcagttattacctctttttggcgcgctttttgccttgtacatcatttgggggtctacctattttgttatccgcataggcgttgaaagctggccgccgctgatgatggcaggcgtacgttttctctcggcggggatgttgctcatggcgtttttgctgttgcgcggcgaaaaacttccgccgctgcgccagaccatcaacgccgcgctgattggtctactgctgctggcggtgggtaacggtctggtgacggtggcggagcatcaaaacgtgccatcgggcattgctgccgtcgtggtcgccactgtcccgctatttacgctgtgctttagctacttttttggtattaaaacgcgcaaattagaatgggtggggattgccattggacttgccgggattattctgctgaacagcggcggcaacttaagcggcaatccgtggggcgcgattttgatcctgataggttcgatgagctgggcatttggttccgtttacggctcgcgcatcgccctgcctgtgggcatgatggcgggtgcgattgaaatgctggcggcgggcgtggtattgctttgcgcggcgtttctttccggcgagaagctcgccacgctgcctggtttatcggggtttatggccgtcggctacctggcgttgttcggttctattatcgccattaatgcctatatgtacctgattcgcaacgtcagtccggcgctggcgaccagctacgcctatgtgaatccggttgtcgccgtgttacttggcactggcctgggcggtgagaggttatcgcccgttgaatgggccgcgctgggtgtgattgtgtttgccgtagtgctggtgactctgggtaagtacctgtttcctgtcaaggcggtggtcacgccgtgtaaaacggaagattcacgccagtagatgaatcccctgggtgtcgatctgcgcgctggcgccgccgccgcagatccactcttccaggcgctccgccaacgccgcgtcgctcaatttcgctcgcccgcgcaaggcgcactcccagacgatcagtacccgccagccaagcgcctgtaaacgctgaatatcgcgctcatcgcgctcaacgttcttaccgattttttccagccagaaagccgttcgcgtggccggcactttgaacagataacagtggtgatgatgccaaaagcagccgtgagtaaaaatcacacaatcataatcattcaccacaaagtccggcttgcccggtaatgtcgcgtcctgagtatgaaacgtaatcccctgtgcgcttaacaggccagcaagacgtttttcaatagccgtatcgcgggtcgctatcgcgcgcatatttttactgcgcgtggctttatcgtgaacgtccgccatctaccgtctctctctgacgcaacgtcaccgcctggtgaattttgggttccaacagctttgctaccgcagcaaataccggcaccaccacggagttgccaaactggcgataggcctgcgtatccgagacaggtatcctgaactggtacgtttgcggcgcctcaaatcccattaaacgcgcgcactctctcggcgtgagtcggcggggacgatgttgttggttgccagcatcgtcgaaattcacttcgcctttcgccatatcccaaccacgatcgatcagaatttcggcaccatctttgtagtagcgagcagataacgtgcgcgccacactttccggattgtcaggataaaccatgccatagccaaaaccgtttccccgcgcctggtgctttttcgcgtagcgatataaatatttccacagcaccggcgtcaggatatatttggcttcgacgacgggctccagcagttctgccagcgtcggacggcgcggtggataacaacgggcgatattgcgtaacgtaaaatcggttttcaggtttaaatcgcgacggaatcccaccaacacaatacgttcccgatgctgaggaagaaagtgctgcccgtcgataattttcggatcgtccgggccattgtcagcggcatccgccacgtcatatcccagttcatcaagcgtttgcataataatgcggaaggtgttgccctggtcgtgacttttaaggtttttcacgttttccagcacaaacagcgcggggcggcgggcgtcgataattcttacgacatcaaaaaataacgtcccctgagtctcgcaggcaaagccgtgggcgcggcccagcgcatttttcttggaaacgcccgccagagaaaatggctgacagggaaagcccgccagcaggacatcatgttgcggaatatgctggcgaatgtgttccgccgcctcatcatcgctgaccccttcccggtggctcaatgtgatatcgcggatatcttcattaaagcgatgttgcagcggatcgcaaaaatagttcgctttatatgtccgtaccgcgtgcttattccattcgctggtaaacacgcactgtccgcctatcgcttcaaatccgcggcgaataccgccgatgcccgcgaagagatcgataaaacgaaaggcgtaatgtggatgatgcgctggcggcgtcggcaactctgttttaagacaggtgagttcattgtcgctcaagcgatgccatgccgcgttcatcattacgcgcttgaagatggccgggctccagtgctgttcgcccaggccgttaaggtgcgccaccagcgttttaacatcgtagatttccagcaattgactcagcatcgcctggagctcgcttccggcgtcgtcggcgatgaggttccgggcgtgtgttactgaaatattttcctgcatacatttaaccggccaaaaataattgccgacagactaacataaaatgacgcggtttacgtttcagcgacaggggttactgatgcgtagcaaacatctggatgaccgcatcatcccgtgtttcatagtcgcctttcagctcagcgctcagtttcgccatgtacgacaccagaaaatccgcattacgctgcgccaggtacttgccccgttcggtctgcatcgtcagcggcagtttcagcagtttggtttgaaaatggtcgagcgcgaattgcttatcgttaagaggccgtctgtcggcaaagggatcgtcggcatcaaataacgcgacgcccagcgcgccggagaccgcgaagacccgcgccagaccaatggcgcccaacgcctccagcctgtctgcatcctgcacgatttttgcctctggcgtggtaggcgcaatttttgcgctgaagctatgcgcttcgatagcatgacaaatgcccgccagtttttctgccggaaagtcaggaaaatcccgcagaaaaatacgccgggtttctgccgccgccagaatggaagaacgatgccgctgcggatgatttttcgccaggctgacgatgtcatggaaataacatgccgatagcaccaccagccagtcgacaggactgttttcccccagcgtttgcgcggttgcccaaacacgacgaaaatggaagatgtcatgggcggcatcctgttcctgatggtggtgacgtagccagtcttcaaactgcgattgccagtatcctgagtccatacgccctctctttatagcagaccatttttattacatgcctgagcacagggttcgctatcctgacatatccgccaccactttacatccctgcttacttgcgcgtttctggcttagtgtcggcgggataagccctgtttttgcgaggccgggtataccaggcaatactccccagaataagccagacgacgcccagcgaaagcgcgttaagccatttttccgttgcgctgccaggagtgctgattgggccgagaaccggctcggtttgtatggcggacatcagccacacgcaacgcgccatcgcccagatgaagtagccgcaaaaggtataaaaaacccataacgctaatttgccgcccatgctacgggtggcgttgtcctccctggtactcaaactttactccgcttttgtgatgtaagtcatatgacattaattacattataatgtgatattaatcacatttcgactatggaatacctcatccacctgttctggctattcattccacaaatagtttattctcagttaatgttacgtctggcgctgaacctgctgttaaataagggaatggtgattgaatcgcactctgatgcagaataacctataaccagaacaacttatttttacgcaccgcgatagcgttttattttatcagcattaagtgtcagaatgattcggttattagccttttatcatttattttatcattacccacattaccggcatttatgccggttttttttatgttttttcataatcaaagcatcaaatacatataaaaaacaaattatattcacaccaacaaccatcaaataaaaaaacataacccattgataaaaaatgataattatagaatatatattcttagttacttatatagtctgtattataaaaaaccaaacagaaacaaattgaaatattttaaatacctttgttacatgttattttttaaattccatgaacttcatagaatagtatcaatttgtagttttgttgaagtggctacatattcatataaattattatcataagggaatacataatgaacagaaaagttctggcactgcttgtcccggcgttattagtggcaggcgcagcaaatgcggctgaagtttataataaaaatggcaacaaactcgacctgtacggcaaagttgatggtctgcgttacttctctgacaatgcaggcgacgacggcgaccagtcctacgcccgttttggctttaaaggcgaaacgcagattaacgatatgctgaccggctatggtcagtgggaatacaacattaaggtaaacaccaccgaaggcgaaggtgcaaactcctggactcgtctgggctttgccggtctgaaattcggcgagtacggctctttcgattatggccgtaactatggtgttatctacgacattgaagcctggaccgatgcgctgccggaattcggcggtgacacttatacccagaccgatgtctatatgctgggcagaaccaacggcgttgctacctaccgtaataccgacttcttcggtctggtggaaggcctgaacttcgcgttgcagtaccagggtaataatgaagatcctggcgcaggcgaaggaacagccaacggcagcgatgcagatagtggtactcgcaaactggcccgtgaaaacggcgacggtttcggtatgtctacctcctacgactttgacttcgggttaagcctgggtgcggcctactcttcctctgaccgtacggacaatcaggttgctagtgggcgtggtgatggccatcattactatggcaatagctatgccggcggtgaaactgccgaagcctggaccgtaggtgtcaaatatgacgcctataacgtatacctggcggccatgtacgctgaaacccgcaacatgacctattatggcggcggcgatggcggtgatggcggtatcgctaacaaaacccagaactttgaagtggttgcacagtatcagttcgatttcggtctgcgtccgtccatcgcctacttgcagtctaagggcaaagatttaggcggccaggatatggatagccgtggtaactatcgttacaccgacaaagatctggttaaatatgttgacgttggtatgacttactacttcaacaaaaatatgtccacctacgttgattataaaatcaacctgctggacgaagatgatgacttctacgcaaacaacggtattgcaaccgatgatatcgtaggtgttggtctggtctaccagttctaagacgctttatgttattcaagcccgtgcttagcgcgggcttgttattatagggtaagaattaaataacggataacggcgcaaagacaggttgacctggtttcatcggatagatgaagacaacatcgcttttttcaggcgctgtctgcaagagaaataacacttttggggaaaggaaaatgccactatagatgatggatgtcagcgtctatagatgataatcatccgggcataaaaaagctcctgtacggagctaatatgaattattttctaaaatctggcggaacctgccctgagcgaatgtataatccaacattatcaaaagtgatcatggttgacttacaaaaaatacatttcgcgccaaacgggttttgctcagtaacatcgaatgtcgatgttctgtattgtgaaccatggcaacatggacaccggaagtgaattttattagtaatatcagttgccttaaagcgccacaacgttgaccgctgatggaccttttggtccctgctctactgaaaactccacttcctgattttcattcagagtgcggaattcattactttgaatggctgaaaaatgcacaaacacatctttgctgccatctttaggcgtaatgaaaccaaagcccttttcagggttaaaccattttactaaaccagtgattttcgtcgtcataatattgttacctttcgaatgagcccttgggcaaaatggcctgaagaaaattatcagagagaaaaaaacctaaaggagatctcaagaggaacaaatgatgagaaatattacaatcactacttcagataagtttgtatcaaaccgcacaaccattaacgcatggttaactgaacatagcaagctttagttttgttaaaaaaatattaattgttttttagcattatcacgctgattgccatactctttttattcatgcctgtcgctacggctgaaacctggcgtaaataagtgacgtctcacaacgcctgccgggcaataaacgcgccacattttctgatgtcgtaaaccaggatacatgcgcctcatcgtgagaggttcctgtgatcttgtgcgaccaaaaccggttagagaacggggatgatttggcaaccatctcaggcattgatcgcacaagttacttaacacgcagtagatcagagtatcttgtggtgtaccgaggcgaaagcatttctcgcttcatagcccactgttgcgacatcccctgcccggcgaagtacagcgtccccttcccgtcttttgcgttaagatggtccagtacttccatcaacttcgcactaccggcgcgcggcgcgttatcgtcgaaaaggttgagttgcgctacgccctgactgaagaagtcacccagcatcacccccgctttctggtagcgatggccgtcgcgccatattttatccaggcatttcacagccgcattgataatgtcacgtgaatcctgcgtgggggtgagaagcgtcaccgcggcgctgttaccgtagtagggctcgttcagggcaaagggtgatgttttgacgaatgttgaaatgaaacggcagtactggtgctcgccgcggagtttttctgccgcgcgcgcagcgtagctgtaaacagcctggcgcatttcctcatagtctgtgacccgctcgccgaaagagcgactacaaacgatttcctgctttgccggcgcaaactcttcgagctccagacatggctctccgcgaagctctctcacggtacgctccagcacgacattgaagtgtttcctgatgatccaggtactttgttcagagagatcgagagcagtcttgatgcccagggcattgagcttcttactgatgcgcctgccgacaccccagacatcctccacgggtatcagggccagcagccgacgctggcgatcgatgttcgacaagtcaaccaccccgtcggtctggcgctgccactttttcgcagcatggttagccagcttggcaagggttttcgtctgggcaatgcctacaccgacagtcaggtgcgtgcgcttcaggaccgtcgctcttatctcgcgcccgaaatctgtcagatcccggcagtttcgtacccccgtcagatcacaaaaggcctcatcaatgctgtaaatttctacccgcggcaccatctcctcgagtgtggtcattacccggttcgacatatcagcgtaaagctcgtaattactgctgaagcaaacaacaccggatcgccggaagcgttctttctgtttgaagtatggctcacctggtgcgataccgagctgtttcgcctcggcgctacacgcgataacgcagccatcattgtttgataacaccaccaccggtcggccacataaatcaggacgaaagaccgtttcgcaggaggcgtaaaagctattaacatcgcagagcgcgaacataatcaactgaccgctttaatgataaaggtcaccaccccgaatatgtcgagcgtgtcttcactgccgacaggtataggtcgataggcgccgttcatggggattaactgcactgtcgggcgcaactgcaaccgttttacggtgaactctccttcaattgccgcaattacaatgtcaccgtggtcagcgttccgtgagctatccaccaccagcaggtcaccgtcgctgatgcctgcttcaatcattgaatcccccgaggctttgacaaaatatgttgagctgggatgagaaacgagcaactcattaagatcgatacgctgctcaatgtagtccgccgcggggctggggaatccacacggcactaagtaactgaaaaatgggagaggaataatttcgcgcaactctgtaggtctgaaaaattccataatccatacctcgaatactgtttttatatacagtagtgttatttgaacatgcgcgcaagataccggagtcgctacgactgtttaaatcttcgtcgcttcgtttgtaagtttctctctcagttcaaattatgggttttgtaaattttccggttgtattgtcatgtgcgcatatttaagccagcctggaggccagattttctgtacagcgtcgacagtcccgcagcgtaagttatcgccacgcgccagcgcgtttccctcacagcaattaatcttctgcccggcgcccatgtctacaggggaacatgtcgggcaacaggccgggtgcgacgatgaccgaggacgacggcgttaagtcgccgcgagtgacatcaatattaatccagatggggtacggcgaaagagcggggcagaaaaccaggagttgacttatgatcgaaaagtaaaaataacaccatccctggccccctcttctggcagaaaaagcataagatggcgatacgtttttcacgtaatattctaacagaatattctaagtgtattctaagtgtgagactgatcgctgaaagaagatgagctaagtgtttgaattgtggcggagagagggggatttgaacccccggtagagttgcccctactccggttttcgagaccggtccgttcagccgctccggcatctctccgtatattgcaatgatgccaggtaatttggcattttaacagaccctattcgggtaattttgttcaagtgacgagtttacgagcaaaacgatgattaagtggccctggaaagcacaagaaataacccagaacgaagactggccgtgggatgatgcgctggctatacctcttctggtaaacctcaccgcgcaagaacaggctcggcttattgcgctagccgaacgttttttgcagcagaaaagactggtagcgctacagggatttgagctcgactcgttaaaaagtgcacgtattgcgttaattttttgcttaccgatcctggagctcggtattgagtggcttgatggttttcatgaagtgctcatttatcccgcgccctttgtggtagatgatgaatgggaagatgacataggtctggtgcacagccagcgtgtcgtacagtcggggcaaagctggcaacaagggcccattattctgaactggctggatatccaggactcgttcgatgcttcgggtttcaatctcattattcatgaagtcgcgcacaaactggatatgcgtaatggcgatcgcgccagcggcatccctttcatcccgttgcgcgatgtggctggctgggaacacgatctccacgcggcaatgaataatattcaggatgaaatcgatcttgttggcgaaagcgctgccagtatagatgcctatgccgccaccgaccctgctgaatgttttgccgtgttgtcagagtattttttcagcgcgccagaactgtttgctccacgtttcccggcactatggcagcgtttttgccagttctatcgccaggatccttctcagcgcttacgggtaagcgctgccgaaggcgactacggcgaggaatccgaacattaattcctcactttgtgggttaattaaccaattgaattggcgcgttaattttactgttgacacgttatagccggcccagtattatgcgcctcgttgaaacaattcctctgtagttcagtcggtagaacggcggactgttaatccgtatgtcactggttcgagtccagtcagaggagccaaatttagggaagcagacgttcactgacgtctgctttctgcatttatatcaactgattaaccccttcttcaggttcactctcgtttactaaaaaccactcgaagctatacccttttgctggtaaagctggttcgatttgcgttttaccagcacgcggagggaacagtcatgtcactgactgatactaaagtaaaaaatgccagaccagcggaaaaggccgtcaagctcgctgacgggtttggcctctatcgattcaaaatactggcagtcaggctatcgctttaatggcaaacagaaggtgttttctattggggtttaccctgcggtttctcttgctgatgccagacaacgccgtgacgaggtcaaaaggctgctggatcaggggattgacccgaacgcaaaaaacaggctgatgaaaaaatccttcaggaaaagcgcgataaaacccgctcgtcccgtgtcgtcgccaaaagctgatgcaccataattctgcctatgatattgacggaaaacttttcgcctgcaccagaaatttatctgccatttccgctaccggcgtcagactgcctgtatcaaccattttcacaaaatatttcacgtctaaagttcattctactccctgcccttaatctctacggcgttatgtctcagaattatttgccaagtgcctgccagtttttcacgtttcatcagacgctggtacatagccattgcggtaaggtcacagcatttgacttgtgcaattacagacaaagttgcgccatgccggagcaaagtaggaattagatcaaaacttcaacgctttgttgtttttgtcagcaaacaaacgcgcaaccttatttccccctttgacaagccgatcgcacatcgttactatgcgccccgttcacacgattcctctgtagttcagtcggtagaacggcggactgttaatccgtatgtcactggttcgagtccagtcagaggagccagattttagtttcgggacatcctggcgagtccggagacgtttaaaaaacaagaaattatctttacccggttgatctgataaggtttgccgggtttttttgacatccatagtttttggggcttaatcgggcctcacggttcgttgagtaaatggagccccctcctatggcattaaccgataccgctggcggcacgcagaccgatccgggtacaggaaaaccgtcagaaaatccacccgccgctcccaataagcccactccaccgaaagaagaaacgccgcccggcgcgccggagaaatacgcgttcaccgcccctgaaggtcaggaactcgataccagcgcgctggcgcagttcgaaccagtggcgcgtgaactgaacctgacgcaggagcaggcgcagaagctggtggacgtctatccgaaagtgctggcgggagtgcaacaacagcaagcggagtcatggcagaagcaaacagaagactgggctgcggcagttaaagccgataaagacattggcggtgacaagctggcgtctaatcttggcgcagctcagcgggctatcgacacgttcggtaccaaagaactgaaagagtatctcgatggtacctgcgccagatctctggtcaatgctgcaccgtgacggaagcgattccacccggcacctgttaccacatcagcgccttttactttacgggctgcggcctgcaaagacgtccggctttgctgccgcgtgaccgtcaatctgcgccagaatccgcgatctttcgcgcccggcactcaaccggtgcgtcactttcgtcgcgcaaagcgacaaagtgacgcacaaccactacaccgcgccatgcccctgttttcggggttccggcgttcattcccgaatctgacacgcctttttggggccgctgtcagcaagaaagaagagaaaaagatcgataccgaggggggggctgatgccccggagaatttctgctcacgcaggcagcctgtaccgcgtacagtctgaaactccctatacctcaacaaactgccactccggcgtaaaggtatcgttctggcgcagccaaagagcatacgccggagactgttcgtgttctcaaaatcacaggagaagtgtatgggcaagttaggtggtgaaatgaaggcactggcaaagcactgtggcggtagccataaaacggtgaacgattgcattcatatcgtgcagcgtttcgatcaccacttacgggctttgaacgtccatatccagcgggttgcgcagattaaggtgcgccacattgaaagctatattcatgaaaggttggcgcaggggatcggcaaacgcacgctgcaaaatgaaatggcctcgctgcgcgctgttctgcaacaggccgggcgtaaacaggtggcagagcatgagtggctgactaataaatcgctgggtctggctggtgcatcgcgcagcgggacgcgacaggcgatcacgccggaacattatcatcatgtgctggagacggcccgcatgaaagctccgggactggcggcggcgctggaactggcgaggctgatgggcttacgttcacaggaagcggtgcagagcgtgcaatggatctggggcatggggacgggcgtgggcggtatgtggcgcaggtgtatgggcaaatttgacagctggctaagagcgagcagcggatggagcaggttaccaccgttcacagttagtgaaagactgggcggaggtggtaaatatcaggctgcattaccttcccccttacagtccaaacctgaatccgatagaacgaatgtggaaattaatgaacgaacatgcccggaataatcgctacttcagcagtacgcgagagttcagggacgcaatatctgtcttttttaaccagacgctgccggatatagcggactcactgacatcccgaattaaagatcactttcaggtgctcactcccgcatcttgaggtttattgggtatataatcgttaataatcatcagcgcgttattatcaaattaaaaacaacgcgctcgtaatacttaaattattcttactggtaactgaagaaaactctctcctgccagaatatgctcctcgcatcctttacattaactctttgtttctatagcatgaaataagtttcagggagttattattcatacaaggagaacatcttgaagaaaatattcataacaattatagtttcattatattgcgcgaatatatgtgcaaaacaatcccccagtacagaatccaaacccgttaatttcatcgcccaaattgaaaatatcgattttaataaaaccgccattagcagtgacctgaaacttttactcgccgaccgttattattttaaagataaaacaccctgtaatactaataccctttctgcgcgcgcagaatcaatgggactgacgacagaagaatatattaataaaatacgcagtttaagaccggctattctcgatgaccgttatttttacctgacggtcgatcagtgcgatgctggcggcacgcccatgctgactggaatcgagctatgtaccgaagcgctgtgcggtgccgaatacatgaaaagatcgtctgacttgtggctggatgatgaactgcaaccgacggttaaacgtcaggcaacaacagtagtccatatgcccctcccctatgacaaagagaaaaaattatggaaagtcaccggctggtatctggaatcctcagaagaaacaggggaggtgatgcagagtaaacagatagcctttgaaggctataccaacgaagaaaacttcgctaaccgacaacgtgtttctgtatttaaatctttctatgaaagcggcaatctcaaaagtatttatcattataatgcgcaaaataagcgtgacggaaaagctgaaacttactttgatgaaaaagacaaaatagcggaaacgctgacgtttaaagatggtcaacccgaaggggaatacatcgtataccatgaaaacggagccgttgaaagtaaacgttactttgcccaaggtaaaattaaagatggcgaatgcccacatttttatgataacggcgttttaaaacaaaaacacagctatttaaatcagaaactggaaggcccggcatttgaatatttccctgatgggaaaataaaggggaaatattcatacagtaaaggcaccattgtcggcaccagtacggaatattattctaccggtaaaattcgtggtgtttaccacagaaataaccaaggtgaaaacgacggaacgttcgaacaatacagtgaagagggcaaactcctttctaaagcgacctataaaaatggcaaacagctttctgctcagagctggtatgaaaatgggcatcccaaagaagaatcctcttttgatagtgaaggccgtaaacatggtgcggtcaaagaatggttcagcaacggaaagcctgcctcatccaaaatgtataaacatgatgtgttagacggggatttcgaaaagtggtacgaaaatggtcaccgcgaatcagtctatccctataaaaacggtatgctaaatggggacgctaagcactggaatgaacagggcaaactcacctataccaccgaatataaagacgataaaaagcagggagccgatcgccgctggagcgaacgtaccggtaaacttgttgaagaggttatgtttgctaatgatgaaagaaacggcctgaaaagagagtttaacgatcgtacgggtaaggtcttaagtgcgctgccctatgtcgatggcgacaaggaaggtacagaagaagcctatgatgaagacggcataaaatacatccgttgttaccacaacgatgaagagctttcagagctatatgcgccgactgacgtcaccaataaggcaaagcagggtgacagcactgcgcaatatcatttaggtaagtatgagtttgaatgcacaaactacgatgcggcgatgaaatggttaactcagtccgcagagcaaaatcatcccggcgcgcttctctttttggcctatgcgtacaacgacggtgatggcgtagcgcaagacagtaaaaaatatctctcctatttattcaaagcggcagagcttggcgaaagtgatgcgcagttagaagtgggatatttaaatcttatcggcgaaggaatgccgaaaaacctgccggaagcctataagtggattaaaaaatccgctgaccagggaaatgctcaggcgcactataaccttggactcatgtacaggaatggtgatggcgttgagaaagacctcaacaaagccaaacttcatcttacagcggcggtaaaaggcggcgtcaaacctgcactggcagccttaaaggaattaacgcctcaaactaagtaaatatgactttgctgtaaagaggctattcaaacggaactgaaaggatacacgttgctatgaaatttaaattcgccacattactcacagccgccacggttttttactcttatcagagcgttgcacaaagtcagcaatcgcctgatgtctggtcagttgtcgaacagaaactgcaaaatgccgtccctttaaatgaaaacaccacttttaaatcgcaggcagcctggtttgaattacacagggaactgtttatgtacggcccgatgagccgtgcggatgcattactgaaaaagctggacacacaatcgaatgatgcgaagttttcgctaaaccatgaggcctcgtggatcgctgaaaataatagcccggatgccgcgatggttttcctgtccaaaattggtctcgataaaccgtcgagcattaccgcctacgagagctacgttgatggctgggttaatcgcaaacagcctgaaaaagccttagcccttcttagcaaaaatgccgacgcgaggaatttttatttagccacggttttagaatcctgtcactcagagcctgataaaaccgccgctatttataatgaaaattacgctgataaaattgttgttccttatactcagctaaaaatgctgcttattattgcgaagcagtaccatgccaagggcgacaccgcaaaggcgttggtttacgcagatagcgcgctgaaaatgtttgatacggctattgctcaacaaccgagtgctgaagcctaccgttatcaagagtatctcgacctgatggagatctattacgccacgggtaataaagagaaggcgatggcgttgtctgcgagattgcgcaaagcaaccggcaataaaggaagctatttccagtattcattaccgggattgctctctttttataagaaaaacgagctgacacagaattatcaggagacgctttcaacctgtgtgacgcaggtcgataaaatattcaattttgccccttcgccgcgcattgaaatggagctgattgatttattaagcaagcttgatgatgttgcgctgatgaataagcgtatcgatttgctgatgagcgcgccggaatatacctgctacgacgacaggtattgctacgagtacaaaatcaaagcgctgaagaatctctttcagcataagcagaatgctgtggcggaaaagcatatcgcaaccctctccgccgaggcgcaaaccctgacgttcgccgaatgggaagatgcaacaaatgaaataggtgaagtactcaaagaaattggccatcctgaggcagcgcaaaaattagccgtcagcgccgaggcgatttacctcagccaagcaaaagcctggcctgatgaagatatgtcgcgttcctttcaaagacttgcagagctttacggctatggcaacgacacggtgaatgccaaacgggtgttacaccagcacgttccctctctcgaagaggaggcgatgatcgaccactacatgaatgcaaaacagtggagtcaggcaagggaattgatgattaacgcagatagggtcgataataaaaacctgatgctgttacgccagatttgttctgaaaacacgcccgagtgtcaggaacatattacctttacgctgaaaaaattaaccacgcaggcgtcgattacccgccaggacgacaccggtaatcagcagctttatcagattgggaatatttttcacagattgggtatcataccgggagcggaacagcaggcgctgattcaggcgttgtataacaaggccgcagagcctaaaaaagccacgccttaatcgatttacccgcccggccacctttctcacatgcgggaaggcggcgggcgggaaaaatcaatcgcggaagtttttgaactggaacggctggcccagattgccgccgcgcatcagcaccatcgctgcctgcagatcgtcgcgggatttaccggtcacacgcactaacgtaaattcgaatccaaacccacagagattaccgcaagatattaatgttgacccaacaccgcctgccggaagacccgcgctggaacgccctgcacgaggagttcagctttgacgacgacgacaacctgctgggcatgaacatgccgcccgaaggtggcgagcatcaggcgaaagtcaaaggcgaccgcctgctgctacagggcagaccaccactatgagtacgacgagttcggcaatcccatcgctgaccgctggggcaaggcgcagtgccggaagcaccgatttgaatggaacggcgagcaccggctggtgcgctttaccgacgtgcgccactatgatgatgaaggctttccgcgccactcgtggcgctatgagttcgataatggcgtgaccaccctatatccctgtccgacgcgaaaatcctcagtatcaagccttctgataatccctttaagctgatcgattctcacggtcggtatctgcttgttaatccgggcttgtgggtccaggcgctcaaggagcgtgaagtgcggcgcaatgttttcgccttccggcgcgtttcctgacgtagacgcgattatcggcgacaggtctccggcgatggtgatgaagccgcggcacaataaggccttaacgggatacagaaccgcctcccgctaaggcttcattcagccactttccatatcacataaatacgcctcttccgctcctgtccagcagcaggcgacagctcatttcgttagcgaaacggtggctcattaaacgtgcgtaatttacgtgagtgcaaacgatcaccttctgcgcgtagtaaatcaatagcacgaataccaatttgcaaatgttctgaaatagccccctcataaaaccggtttgcctgcccgggcagtttaatttcaccgtgtaaaggtttgtcagaaacacaaagcagcgtgccgtaaggcacgcggaagcgatagccctgggctgcaatcgtcgcgctctccatatcaatcgcgaccgcgcggctaaggttgaatcgcagcgccgatgcggaataacgaagctcccagttacgatcatccgtggtgacgaccgttcccgtgcgcagtcgctgtttcacctcttcaccgggcattccgctaaccgctttggtggcgtcgtacagcgcacgctgtacttccgcaatgcttggaataggaatatcaggcggcagaacggcatccagcacatgatcatcgcgtaagtaggcatgggccagcacataatcaccaatcgcctgactttctcgtaaccctccacagtgcccaatcataagccagacgtcaggccgcaacacggccaaatggtcgcaaatcgttttagcatttgaagggccgacaccgatatttaccagcgtaatcccctgcccatctgccgttaccaggtgccaggcgggcatctgatgcttcttccaggccagatcggaaatagcctcttccggcgcttccgtttctgccgtgatccaaattccgccggcacaggaaagcgcgatatagggactgtcaggatcaagaatttggctgcatccccagcgcacaaactcatcgacatagcgggtgtagttggtaaacaaaacgaagggctgaaaatgttcaaccggcgtaccggtatagtgccgtaaccgggccaacgagaagtcaacacgacgcgcgtcgaagtgcgatagcggatagaattcgccggggtggaacagaccgtctgccgtctcatcgccaatctgcgccagttctgtggtaggaaaatggcgcgttagcccggcgctcatagaacgatccagcgtcagagccgagccatcgatcacataaggatacgggatctcatggtgcgaggcctctaccgcaatatgcgcgccataatcatggtaaacgaggttaagctgttccagaagataagcgcgaaatagcgcaggccgcgtaacggtagtggtataacagccgggatgagtaaagcgtccaaaagcgcgtgttttaggcgggttcggtgtcgcgccatcccagcttacagacagcgaaggataaacaaacagtccgttaagcctggcgtggggatcgggcagcgtaccgttatcaacatagtcagcgatggcttcacggagcgcgttaaccgactgctcgtatagctcctccaggcgatccagcgcctgctcgggcgttaggtttgtgcctttattttccatattattctccttagcgttcacaggtgaggcacgtcattcgatagtatgacagcaaaggaggaaactaaaggggttagcgtaagggtggcgacagtaaacatgaaccctttaaaaagaaaagagaactatcttagcgccaccatcatcgctcaaaaagaagggtactggtacagccatttgttaagttcattacaattagtcatataaccatttcccggcttttgctgactcgatcagcatgctgatagtgaaatctgggacgggtacaggttccgttttcttgaacggatgccatgaaaaagggtgattaggaaaataggtttctattctgaagttacctcgctcgacattgagttcctcgaagaatttattcatgagatcttcggcttcaagttcatcaatgctcagatcagtatcaaggtcaatctctggtgttaattccacttgcttaatgttgaaaagatatgtgccagcataaggccgtacaagctcgtaaacttgctgttcaatattgtctaccataacttatcattgccccgagcaatggtattgtagtcgcgtatagtgcaatatgttatttgtgacacatctgcggcaaggataatttccccgatcaaaggaatggaacgtccaacaaacggcgcaatgttacgaaccataacacgtctggctgtccatggggtgtaaccgcctaaccatgtcggaagggatattccaaagggaaattttgactttttaaacactgcacgtgcagtcctggacgcgtatgatgtgcctttagtcgctccagcgggtttcgcccttgtccaaagattattacgacctgatgccaaagcaacaacagccccgaaatctgcaacaccaatcccaaactggcttgcggtattctcacaaaaaatcataacagaagttcggcagcagtcagattggattttcctgcatagaagtatgttccatttagttcttctactgtatccattagaaactctatagttactattttggtttacttattgtacatccttgtttcgaatgaaagaaatcaatcttttgggaaagaacggatcaagatcactggaaatatctgaaatcagatgaaagagacagtcgcgattcccaccaggggcatcacctggcaagcttgtgtgatcgctccgtttgaaccgaacacatctatatgtcagcatactgatacgggtttgatcttgcggatagcggtatcggttaatgccatacgtaggggctccattttctcagcgaaccgtgaagcctccgattaagcccccaaaaaccatggatgtcaaaaaacccggtaaaccctctcaggtcaaccgggtaaagataatttattgttttttaaacgtctccggactcaccaggatatcccgaaactaaaatctggctcctctgactggactcgaaccagtgacatacggattaacagtccgccgttctaccgactgaactacagaggaatcgtgtgaacggggcgaatattaacgaggtgcccctggcttgtcaaagcctgttttcacaaaaaaagttcgtttgctgctttattccacacttcggttaaaattcaccgtttcctgatgattttcacagcaaaaagcgcttactccctctttacgcgcgggtatctccacagccagcgcccgcttatcagacgccagtaaaacagtgcgccacgcacggcccagtcaagaaacatccccagccaaacccctacaacccccatacccagcacaataccaagcgtataccctgccacaacgcgacagccccacatccccagcatcgatacccacatcgcaaatcgcacatcgcgcgcgcctttaaaacccgacggcaacacccacgcggccgcccaaattggcataaaggcagcattaagccagagcagaactttcactacctcttttacgtcctgctcctgggtataaaatgaggcaaacagacccgcaaacggcgccgtcccccaggcaattgccgtaagtacgatagtcgacatccagaatacatggcgcagttgacgctctgcctgaccaatttgcccggtaccaagacgcttaccggtgataatagtcgacgccgaaccaagggcgttacccggcaggttgataagcgccgccacggaaaaggcaataaagttacccgcaataacgttagtgcccattccggcgacaaacatttgcgtcagtagcttgccaccgttgaacagcactgattcaatgctcgccggaataccgatacccatcacttcccagataatgccgaaattcagcggcttcagatagcttttcagcggaatgcgcagcgccggattaaaaccaatcatcagcacccaaataatcgctaccgcgccgatgtagcgcgaaatggttaatcccagccccgcgccggcaaaacccagcccttgccaggagaaagccccgtaaatcaggatgctgctgataataatattgagaatgttcatcccgccgttaatcatcaacgggattttcgtattccctgccccacgcagcgcgccgctaccgattagcgcaattgccgcagccggataactcagcaccgtcagttcaaggtacgttaacgccagcccctttacttctggcgtcgcctcgcctgcgacaatattaataatttcactgccgaaataatgaatgaccactgccagcacaacggcaaatagcgtcataatcaccagcgactggcgcgccgccgcccttgcgcgtcgcctgtcgcgcttgccgaggctaaaggcgaccaccaccgtagtaccaagatcgatagccgcaaaaaaagccataattaccatattaaaactgtcggcaagccccacgcccgccattgcttccttgcccagccaactgacgagaaaagtactgagcacgcccattagcaaaacacaggtattttccagaaaaatagggatagcaagtggggtgatttcacgccagaacaacactttgtagctcttgcgtttggcataccagggcgtacggacgacagcctggcgtaaggcagtggagacgttcaaaatggaccttaaagaagagagttgaaaccacatttcaataatgagcgagaaatcgtaaggctgcaaagctttttgcagaaaaaatgtctgcaaatgcaacaaagtgatgagataacccgcaatcgaatctgtaagaggttaaatggggtttgacaaaaatttttccgccgctaatatacgaccccacacgattcctctgtagttcagtcggtagaacggcggactgttaatccgtatgtcactggttcgagtccagtcagaggagccagattttagtttcgggacatcccagcgagtccagagacgtttaaaaaaacaagaacttatctttacccggttgacctgataaggtctaccgggtttcttgacatccatagtttttaggggcctaatcgggggcctcacggttcgctgagaaaatggagcccctgccatgacactcactactaatacagatactccagcccatgaaaaccagcaatgcgacaggatatttaaaggccaggcctgcccgcgctaatgttgaccggcattccggaacggcgctccagcacctcattaacccgcgaagtatcaacgtcatcccctttgataaacgtgcgcagcactggcgtaacgggcaatggaacttttttgtctgactcaaattcagcacggttgcgagaaagcggttcgtgtacctccagccaacgactgccatccggctctaccgaaaatttaacgggcctgtcgataatctgaacgcgggttcctacaggaacatggtcgaataaatatttaatatcgtcattgcgtaaacggatacagccctgactgacgcgaaggccaatgccaaagttagcgttagtgccatggatggcatataacctgccgatatatattgcgtatagccccatagggttatccggccccgcaggcaccatcgcgggcagcgtttttccctctttagcatattcccgacgcgtattagccgttggcacccaaaccgggccatcttgtttgcgttcaaccgcagttacccagttgcgcggcgtttcacggccagcctgaccaataccaataggtagcacctcaaccgtattcgtgcctgcgggataataataaaggcgcatctcggcgacgtttaccacaataccttcacgaacggtgtcaggcagaatcaactgctgcggcaccaccagtgtggaaccagactgaggtaaaaacacatccacgccgggattcgcttcaagcatattactcagcccttgaccgtagcgggcggcaaatgactctaagggctgagtattgttctgcggtacggcgattgtgacaggctgtcctaccagacgactgccttcgggcggcaacggatagcttatagccagcgagaaatggcttaccaacaagacgaaaaacggaaaaaaaggtgtgatacgacgcattatatcccttcctttgtcgcggcaggtgtgcgttaagtatagcttttttctcacatggctggtgttgtgcgcccgggttatgttgcgtttgcgttcccctccggcaggacaatattactggccgccaactcccccatgttgtggaacatggcgcacgcggcttccacgatcggcatcgccagcgccgcgccgcttccttcacctaaccgcatcgccatatgcaaatagggttccatagacaaatgcgcgagcgcgatgcgggcgcccttttccgccgaaaagtgcgacgggatcagataaggtctcaccgcaggcgcaatctgacaggccgccagcgctgccgagtaggaaagaaagccatccagcaatacgggtaagccacaccttgccgcgccaagcatcacgccggtcatcccgaccagatcaaaaccacccaccttcgacaacacatcaatgccgtcgcgcggattgggctgattaatcgcaatcgcccgccgcacgacgtccactttattatcgatgcgggaaggcggaagattcgcgccaatccccaccacctcttttgcatcacttcctgtaaaaacgctgaccatcgcggcggctggcgtagtgttcgccattcccagctcccctacgccaaataaggtcacgccgcgttgcgccaggtcgcaggtgtagcgggaaacctccagcaaaagcgcctcagcctgcaagcgactcatcgccgggccaacggcaatatttccgcagccgcgcgcgacgcgcatattaactacgccaggaataggttcggcatcaataccgacatcaatgacatgcaccttcgcaccggcctgagcggcaagcacgcatacgccggttgttccccgcgtcatattcgccgcctgaatcgccgtcacgattttgggcgaaaccgctacgccttcatcccagacgccatggtcggcgcacatcaccagcaccgccttttcacctacctgcggcgtaccgttaagacccggcatacccgcgagctgaacggctaaggtttccagtctgcccaggctgcccggcggtttgagcaggccgtcaatatgttgctgcgcacgcgccatcgcctcggcgtccggcgcaggaatgtcacggagtaaagcgtgtagtgtctgcataagatgtctcgtccgtaataatcggctcataacagagccagcagaaagatcaattcaccaagttcgatcgccgcgcccagcgtatcgccggtttgaccgccaagcgtacgtttaagcaactggccaaggatgaaaatcgccgcgcatgtgaccaccattgcggccaacccttgcataccaggcagtaataccgtggcgacgattaccgccaatcccagagtaatgcaggtttgccgtccgctgactttaccgataaatacattgccaagcccctcttcacgggcgtagcgatgacggtacatcaataaaacggcgctgccgcgtccggccgcacaggccgccgccaacgccgccaacattggcgttccacgtaacgccagttcgctgaccaccagaatttttgccagtagcacaaaaataagcgccagcccgccatgggttcccagacgactatcacgcataatctccagcattcgctcacggcggcgcgcggaaaaaatgccatcgcaggtatcggccagcccatccaggtgaaaaccaccggtcagcagcgccagcgccagaatacagaacaacgccgctagcggaataccacaccagggttgcaggaggatgaaaatcaggccgcttacgccccccagaatcaacccgataaagggaaacatcacgatcccacgcgaatactgctcgaaatccagtccctgcgaccagcgtgacggcacgggcaagcggctaataaaagcgagcatggcccaaaacagcttactcatttaattttgactccaatacctgagactaccagccagacctcatccgccgctgccgccagtcgttggttgacccgaccggcaatatcacgaaaatggcgcgccagacggttttccgggacgatccccattcccacctcatttgtcaccagtaccactttcgccgggcagcgctggcaggctgcaattaaaatctgaatttcatcgtcaatggcgcgctccatcgccgcgtaatcccactgttcgggatcgttctcgcctcccagcgcaaacagcagattcgtcaccatggtggtaatacattccagcaaaatcgcgtcgtcaggggcaagatccgcggtaatcaacgtatcaagatgccgccagcattctgcggtccgccagtgtgccggcctgccatctttatgatgctgaattctcgccgccatctcgtcatcaagaatctgcgaggtggcgatatacagtacctgcggcgcatcgccaattaaggcttcagcatgacggcttttaccactacgtgccccgcccgtcaccagaatcatcataccggctcctgatgttgttgcatgatggtataaattttatcaatatcaatatgttgccgcatcgcttccgccagcagatcaaattgccgcgctttatgatccgcataacaaaaagtcgtttcccacggcgcaagcccctttcgcgcccgtaacccattgaccaccgcacgggtaaaggcatcgctgtcaaacaggccgtgaaggtaagtgccaaacgccagtccgtcggcggtgaccgcgccatccgccacagagcatccatttttctgtaacgtcatggccgtacagcatccttcctgcagcaccgtttcccccatgtgaatttcataaccgcgtaccggtagccccgccgcggcagccagccagccgggcagctcgcctgacattgtcgcgttaacctgcgtcgtggttttatcctgtgcaaagcgagtgattgtattaagcagccccaggcccggctgcgtacccagccccgactccacctcatccacaatggtgtcgcccagcatctggtagccgccgcaaatccccatcaccggcacgccctgccgatgtgtctgcaataccgcatccgccatcccgctttcgcgcagccaggcgaggtcgctcagcgtattcttactgcccggcaggatcaccagatcaacgtcagtcaacgcttccgggcggcgaatatagcgtatgcgcacatccggctgcgccgccagagcgttaaaatccgtaaagttagaaatatgtggcagttgcacaatggcaatagtgatatcacggggggcgttaccgcgatatttatcgttttgcagcgcgacgccatcttcatcttccagatccacatccagccacggcatcactcccaggaccgggacgccggtaagcgattcgatttgttcgataccggaatagagtagcgccacgtcgccgcggaatttgttgataatgacgccctttactctgtcacgctcctgtttatgcagcagcgccagcgtgccataaatagcggcgaatacgccgccccggtcgatatccgccaccagaataaccggacactgggccatttccgccattcccatattgacgatatcgcgatcgcgcagattgatttccgccgggcttccggcgccttccagcacaataacgtcatattcctgcgccaggctgttatagaccgcaaggatttgctcacgcaaacgcggtttatagtcatggtaactaaccgcatccatattggtcgccactttccccatcagcacgacctgcgcctggcgatcgctggtcggtttgagcagcaccgggttcatacgcacatctggcgtgatccccgcggcttccgcctgaaaaatttgcgcccgccccatctctttaccatccggcgtaataccagaattaagcgccatattttgcgatttaaacggcgcggtacgcagaccatcctgataaaaaatgcggcataaacccgccgccagcacacttttgccgacgtcggatgccgtcccctgcaacataactgcctgcgtcatgacgcctccctgaatgcgcacttttgcattcgatgaaaaaactccgtttctgttttacacagcggcagtcccagttgagtatgaagtttgaccagccagggctgggttagccccgcgtgttccatcgcttccgtacacgcgaaaacctcgccaggcgcgccatgcgtcaggatctggccctggcgtaatacgtatacggcatcgctaatttcataaataagatcgatatcatggctggatataatgacatgattgccctgcgccacaatccgcctgatgatagcaatcatctgagtgcgccctgcgggatcgagaccagcagtgggttcatccagcaatagatagcgcgcctgtagcaccagcgctccggcgatagccacacgttttttttgcccatgactcaaacactgaatgggctgatggcgaaaatgttgggcgtcaaccagcgttagcgcctcgtcgacgcggcgcgtgatttccgcctccggcacccccaaattacgtaaactaaatgcaatatcgctatcgatatcagtataaaaaatctgctgttcagggtcctgaaaaaccgtcgcaacttgctggcgcagcgccagtagtccgcgcttgctgtaatccagcggttttccctgccacaacacggcccctttttgcggacgcaacaagccgctcaggttcataaaaagcgtagacttcccacagccgttcgcgcccaccaaaccggtaacaggcgaaagcgaaaaatccatatttaaccctttaagtaccggctcattctgataacgaaaccacaggtctgaagtggcaagcataatagtccttacaggtgaaaatcaccctgatacagtttgatatccagcgtggtggtcatttgctgataacgcattaacacccgcgtaaacaggagtccagccagcatcgccagagatcgatagccgttcggcaggctgcaataaccaaaacgcagcgtttgcgcacgacggattgccaccgcctcatccagaagaataaagagaaagcgccacgttaacaggatttgctcggtaagcaggcgtggaatatgcgcgcgcttaagcaagctaattaactgcggaaacggtaggttcatcaccagccacaacgtcgcggacagcgccgtcaggctacgccagaacgtttcattcgccgtaaccacgcccgcacgggtaatcccgatccagtacggcccaacagatatgccagccagcagcatttgcggctcgcggctgatgctgaagataatcgttatcacgccgaccaacaaaaatccaaaaggtatcgccatccatcgacaccagcgccagagggatatgcgcaatagccaacagctcaatccggcaatgatcagcagctcaatgccctgccctacaggcggcagaacaaacgccagtatcatcatcgccagccacagcaaaaacttgcgctgcggcgcaacgtgtgcccagcggctttgatagctgagtcgatcaagcccggtcatcacggcgttgtttacctttgcaataccccaggatataaaaaatcaccgccgcgccaagagagccctgaagggtaaacagcaggctttcaatttcaccgctggcaggttcatataacggctgaaaccagggtttatactgcggcgcaatagcctgaatctggctttccgcttcgccgtctgaaccgccatattcaccgccatggttaataaaaaacggcagaatcaccagcgccaccaccatcgctaacaacatcaacgtttttttcattttaatgtccttgtacggtaatcacttgccgtttggttaactggtcataaatcatgacggttaataaaccttcagcaatggcgacaggaatctgtgtgaggcagaaaatccccataaacttcacaacagaccctgtcgctccggcatggggatcgggaaacgcaacgccaagctggactgaagtcacaaaataggtcgccaaatccgccagcatcgcgcacagaaaaacggcgacatcacggcgcagtccggcacggcaggccattttccacaccagataaccgacaaccgggccaatcaccgccatcgacattccatttgcgccaagcgtcgtcaggccaccgtgcgccagcaatagcgcctgaaacaacagcacaaccgcgccgagaatcgccaccaccccgggcccgaacaagataaccgccagaccaacgccggtcggatgtgaacaactccccgttaccgacggaattttgagcgcggacaggacaaaaataaacgcgccgcacagcgccagcagtaccttctgatgattatcctcctgcacaatacgccgtaagcgcaccagtccataccacaagcagggtaaaaacagtagccaccaggccagcgcccacactggcggtaaaaagccctccatgatatgcatcgcaaacgcctgttgcgggacaaccatcagcaatagcgctgcagccagtccactgaaagacaactgtcgaagctgctgttcaagtttcattctgcatactcccactgtttattgaccagaatggtcgaaaaatagggcaacggtcgatcatcgttgacctcgtggagatggcgccagcactgctcgccgggcagtgtggcctcggacatcattaaggcgcattccagcaggccagcctgcgccagcaaagctttaatacgggcgaaccggccatacactttcatcaacaccaggctatcatgctgttgtagcgcctgggctatttccgcttccggcgcggtacaagaaataaccgccagcgattgccgttctatggcgagcggcattttcgcgcgggcggctatcgcggcgaaggacgtgacgccggggacaatctccagccactccgggcagccgattcgctggagtaaaaaaatccaggtactgaatagcatcgcatcgcccagggtaataaaaccgacctgtttacccgcttccacctctgcggtaagcgcggcggcaacctcgttccagaccgcttctttctcggcgccgtcagcgctcatagggaaatggcaacaacgtacttccgtctgctcgccgagatagtcgcgcacaatcgacagcgccagactatcgccccccttacgaccggcgggcgcatacagaatgtccagcgagccaagaatccgcgctgcgcggacggttatcaggtcgggcgcgcctggcccggtacttaatgcgtataatttaccgttcatgccgcctcctctaccgccatgttcagcgcctggtgcaaatgcgcgacaaacatcgcccggatagccgggttttctcccagcccgctcagccacggcgtcgccggaatgcccgccgcgttaaagcgcattttccatgagtcgccgtcgtctgaagccatatcattaatggcgtgatcgcccgccaccagcattaatggcatcaaatgtacgccggtgacgccttcgtcacgcaggctgtcgatcaggatgtcgacctccgggtagctttctacggcgccgacgcgcgccggaaagcgctgcgcggtcatcatatgatcgagacaggcataagctgcgaatgcgtgatggctggcgccgtggcccataaaaacgactttctccgtttgtctgagcgatggcatctgttgtcgcaacgcctgcattagctgcacataatcgttatggctgctcaacagcggcacgcccagcgtcaggcgagtgaataacggacgcaagagttgtacttcacggacaattttttcatattcgtcgccgttaataatgtgcaacgactgaatcgccacgtcctgatatccctgtgcggcaagcttttgcaaagcctgtaatggcgtatcgatgtcgataccgtcacgctggcgaagcttgcgaatgatcattccggaagtgaaggcgcgaaacaggtcgcgatcgggacaggacgccgccagatcacgttcgcacgccacaatgtttttttcacaggtgtcgtgatagctggtgccaaaactgaccaccagaagcgcttttttcatttttactccttagctgcggccagccagcgcgataaacgctgcgcaaaggcggcctggctttccagtaactcatcacccgtcacaagcggcgtcgggcgcgcaataacgatgcaaggaatgcccgcatccagacagggctgaactttttcctgatatcccccctccgcgccggacgctttggtaatgaccacgtcggcccggcactggtggtaaaacgcggcgttaaaatcagcgctgaacggcccacacagagcgaaaatttctccaacgccgaaccccagttcgctgcagcgttgaatcacctccgccacgggcagtacgcgcgccagcaacgttttttccgccagcccggcacgccagacggccagatctttactgccggtcgtcagtaacacgcgcggaccaaaacgcctcgctatctcgcaggcatcggcaatactgcgcgccgtatagagaagcggatgcgtcagattgctaagctgctccggacgctgataacgacttaacaacacgcctgccgtttcacaggcgcgaaggaggttatggctgaccatttctgcataaggatgcgatgcatctattacccagcgagtacggttttcttttagccaggcgaccatctgcccgtactccagacgaccacagcgcacctgccctttaatgtcgcccgccagcgcttttccggctggcgtcgccacggataaggtgtacgcgacgttcgccgcatccagttgtcggcataacgcgcgcgcatcgctggtgccgcccaccaccagcacatccccctcattcacagcgtgtaacctcgcggcgttatcatcagcccatcctgaacataggtcgttttattaccaacgatgaccagactggtcatatctaccggttcaaaatccatatcgccgagcgtagtcagccatttttcctctttcttacgtccggcggatttcaccacgccaaccggcgtttgcgcgcttttactggcggcaagcaggtcaaacgcgcgcgccagatgcccttcgcggccgcggctgcgcgggttgtaaaaacagataacaaagtctgcctctccggcggcaacaatacgtttttcaattaccggccacggggtcagcaggtcgctgaggctgatatgacagaagtcgtgcatcagcggcgcacccagcagcgaggcggctgcgatactggcggtcatccccggaataaggcgaacctctacatccagcttctgcttgctcaccagctccagcaccagtcccgccatgccgtaaataccggcgtcgccgctgctaatcagcgccacgttatgcccggcctgcgccagctcaatcgccgcctggcagcgttcaatctctctgcacatcccggttttgatcacctgcttatcgccggtaaaggctttcaccaggtgggtgtaggttttataaccgacgacgatttccgccgcctgaagcgcctcaatcgcctccatcgtcatcattgcctgcgaaccggggccaataccaattacgctcaacatcagtgtgcaactcctaaagtaatagtgacgccctgttctcgcagggtctcgcctaacaattgtccctggcttaataaccacgctgccgggccggatacgctgccaacgcccaccgtttttctgacgaagccagaaccgggaaaatggtgttcgaattcgcgtaacgcttcggcggtaaaggttttaaaaggcacgcggcagcaggaggcgagctgaataagccccggctccccttttttgagcgtgacgctgccaatcgcttttaacgccagcggatcgagtttctgcgcttcaagctggcgcgccagtaatgtcgctaacaggggaaatggcgtatcgcggcggcagccaattcccgccaccacgcgctggggcaccagtttccagtgcggtacgggaagctcagggaggtcattacgcaaagagacgcagataagcgcatccagttcaggcagccgctgcaaatcatcaacagggataaaaccgcgaatatcacactggccgatctcttccgttagttcggcatcccaccataaccccacacgttgatgactgaccaacatctggttaacggtttttaccgccgttcgaagatcggacatgcgggcgttaagctggaaagctaaggtgtccaacgcggacatctcattgacatccgttgccgtggtaatcaccggatcggcgcctaacattcctgccaggtagcgcgtcaaggcattggccccgcccgcatgaccggaaagcaggctaatgacatgctgacctcgttcatcaatgacgaccaccgccggatcgctgaacttgtcgttcactaacggcgccaggacacgaacggcaatgccggtcgcgccgataaaaataagcgcggtataagtggtaaaagcctgccgggcggtattagcgaatccgccatcgaagggaataaatccctcttcccgcagtttttcactggtaaagcaggttaacggcagcatcgcggcgagtctctttgccagcgccacgccgccgggcgtcaggcaaaacaacgcaatggattcaggctttacggtattcatggctaaagtccgctgcataaagtcttgagtagtgatactccttacccagaaaattcccgaccaggattagcgccgtcttacggatgccagcatcacgtactttgtcgctaatatccgctaacgtgccgcgaacggtctgactttccggccaggtagccttataaatgaccgcgacaggcgtagttgccggataaccgccggcaatgagacgttccgccacccggtgaatacgctgaacggagagataaatcgccatcgacgtctggtgactggcgaacgcctccagttgttcgcgcgccggtactggcgtacgcccttccagacgggtaataatgagactctgcgatacctccggtacggtatattccacacccagctccgccgcagcgccgagaaacgcgctgacgccaggcactacctgccagtcgataccacggcgagttaactcctcgccttgctcacgtacggagccgtacagcgagacatcgcccgtttgcaaacgcaccaccgtttttcccgccttcacgcccgccgccatcagctcgataatctgctcaagatgcagttcggcgctgtcgtagcgttctgcctgcgcggggcagtaatccagcagttcggtattgatcagcgaaccggcatagataactacctgcgcctgttgcagcaggcggtagcctttaagcgtgatcagctcgcgatcgcccggcccggcgccgacgaaccatacacagcgtggatcaaatgtctctgacatggttttcttccttctgacaggcgataacaaaaacaggattgttcggtttgaaatagtgccccgcccccagcggcgttaacgatgaaagctgaagctgtacacagtccattcgacatgcgccgatgtgcgcaagatgcgccagcgcgctatgaaggttttcctgcaagataaaggtcatcaccagacggccaccgggatgcagatggcccatcgcccagtcaatcagcgccgtcagatgtccgccgctgccgcccataaacaccgcatcggctttcccggttatggtcattggcgcttcgccggggagaatatcgatattgccgcaggcaaagcgctgacgattctcatcaagcagccgtagtgcggcaggattacgctcgatagccgtcacctgcaacgaaggaaattgcagcgccgcttcaattgagacgcttcccgttcccgccccgacgtcaatcaggtgactggcgcggtggagctcaagtttcgacagtgccagcgcccgtaccgcctctttggtcattggcacgttctcgccgcgcagaaaaagctcatctttcatcaaggatcaccactgcattcatttcatagtcggcgttgaccgcactgacgggtagccagtggatccgctcattttccatcgccagattttcaccaatcaccattaagcgatgccctttgccccgcgcgaccagttcccgcgcgatttctcgcggcccgcagcgggcatccgtgaccatcgccactttgcgatggttcgctaactgctcgaagctgacgcaacgaccgtggctactggtcaaccacatgtcattcatatcaattccagcctgtgcgcacagatactgtacggcgctgatgccagggataatgcgaacctgttcgataccaaaatgcgccaccaggcgtgtaccgatgccataaaacagcggatcgccggaggccagcaccacgatccctttatcccgacgggcggcaatccatgacaacaacgcgccaatatccgcgcccagcgtaaatcgttcgccgccaaacgccggaaactgcgccaaatgccgtttaccgcctgccagcgcatcggcgtggtctatcgcttccagcgccgcaggcgtcatcaaatgccgtccagcgggccccattcccacgaccgttagcattgcagctccttagcaatctcgtcgacgggacgattactgccgagaatatggttatcaaaagaaaacaggatggcgtcgcagacaggcggcgttttggtaaaacgcagcatctgcatgactcgcaaacaaatacgcctggcaagatggttatagatatgcccgaagccatatgcttcaatgtgctccattgccgcttcggtggtatcgcaatcgctgaccagggtgagtaactccagcggcgcgcccagtaaagctaaatgcgcgaccagcgtttccatgcgcgcatcggcaatatggctatgggtatgaaagatcccggcggcgattttgatcaattttccaggatgacccaccagcactatctggcaaaatcccagccgtaccgcctcttcaatcatgtagccgacaaaattgctcatggtgacgactgcctgtgtgtcgacgcccatttgttcgcgaacaaaccgttcgccgtggttgcccggcacgagtatcacccgcgttaatcctgacgcccgtttgatctccagttccagcgatagcgagcgtttccagctttcttccgacatcggcgtcacaatgccggtagtgccaataatggaaatgccgccaagaatgccaagccgcgagttatacgttttttgcgcccgcgcttcgccttccggggcaaaaatctccacatcggccccacgcgccgggcctatcgcttcgcgcaccgctgactcaatggtatggcgcggcgtacgattgatggcggcgctcccgagcggcagtccaatccctttacgcgttaccgtaccaataccttcgccgccagtgagcgtaatctcaccgctgtcgttgagcgtaacgcgggcaaaaatcagcattccgtgcgtggcatccacgtcatcgccgccatctttacgaattgcggctatcgcctgctggccttcaatgtgcggcgactccacgttcaggcatagcgtgacgcccgacggcgtgacgatggagacctgatgaatcagatgttgacgtaataccatcagcgcggcgacttttgccgccgccgtcgcgcaggaaccggtggtatatcctttacgtaacgctttaccgtggtgccagaccggcgcgtcaaaagaaagctcgctcatcaggcctcccggaggtgatagagcaacgcattgacgatagcggcagccacgttactgccgcctttacgccctaacgcggcaaccgcggggaaatggctatgggtgagtgcctctttggactccgccgcgccgacaaagcctaccggtacgcccaccacgccgctcaccgtcacgttatgttcaagcaaacggaacagggccgtcggcgcattaccgaaaacaaagagcttgtttttctcctcctcggcgatagcgatatcgacggcggccattgaacgggtaatcccctgcgtttgtgcggcgcgcaccacgcgcggatcgctgatataacagcgacactcgccgccaaacgtcgccagtaatcttttattaatgccggacagcgccatcgtggtatcggtataaataatgcacggatggcgtaacgcatcacaaagctgctccagcgcatcggcagagaaccacaaaatgtccagccagtcgaaatcggcggtggtatgaataacccgcttgataatggcctcatggagcggactggcgaaacggtaatcaggacgcgtttcgcgaataatgtcgctaataatggtgaaactgttggcctcaatggtttggggctgctggatataatgcatactgtcgtcctcaggccacgccagataacccgcaccgcgccgcaattaacagcgccagcgccagggttgaagcgacccacatcaatcgaatcgttcgggaaatatcgtccacggaaatatcgcgctgcgcgtcgcctatccagggcttgtccacacgctcgccaaagtagttatttgggccaccgagctggattcctaaggcgccggccacacacgcttccgaccaggcgcaatttgggctactgtggttataacggtcacgccagccaatacgcagcgcccgccaaccactcaggcgacacagtcctgccgcaatgcccagcaacagccagctcagtcgggcaggaagatagttcgctacgtcgtccatacgggcgctgaccataccaatcgcccggtatttttcatgtttgtagcccaccattgaatccagggtattgacggctttgtaggccatcgccagcggcgcgccgccgagaaagaggaaaaagagcggcgcgataatgccgtcaacggtgttttctgcaaccgtttccaccacggcgcgattgatctgcgctggctgaagttgcgacgtatcgcgcccgacgatccaggagagttttattcggctttccgcaaggtcgttcttccgtaacggtcgttcaacctcctgcgcggcgtgggccagagagcgtccggccagcgtggtaaagatcatccagacttcgacgctccagccaaaccaggggtgaatccgctgcgccagcgccagtacgccccatgccacgccccaggtcgccccgacaaccacaacccacattacgccgccgccaatccgcagcgctttatcgccgggacaatagcgacgcacaatacgctgcacaaacgtgattaaacgacctatccagcgtaccggatggggccagtgttgagggtcgccgatgataaaatccagcacccaggcgatacaccaggcaagaatcgtcataatacgcgcctcgccgccgccagccagtgctgcaacatttccggacgctgggcgaaatggacgtgcagatagctggcaaacgtgttgcctgtctgccagccgccagtccattcctgtaacacgcggccatcgcgaaccttacgacaggccataacggcgggtgtttcggggataaaatctgagtagtgaaattcatggccgcgcactatctcgccaggcgccgccaatagcgttggctgcatagcctgcgcctcacaataaccaaagcgggtgagtcgcttacccattttgctgtgaccggggataatattcgccatctgatgaatttccccgccgctatcctccagagtgctccccagatacatcagaccaccacactccgcgtaaatcgccacgccgcgctgatgcgccgcccgcaaatgttttaacatcaccgtatttgccgccagatccgcggcgtataattcaggatatccaccgcccagccagatcatctgacaatcaggcaatgcgcggtcatgcagtgggctaaaacgcacaatgttaacgccggcacgctccagcaaatcgatgttatcgggataataaaagttaaaggcctcatcatccgccagagcaagcgtcagccctgcccccgctgtgttatcggggcgttcaggccacattcccgccggaagcgcggataacacgctcagcgagagtagcgcatccacatccactgtttgttccagcgtggcggcaaaatcatgccatgattgctgattgacgagggattctctggcagtaatcaaccccaggtggcgttcaggtaatgcgacgccgtcgcaaggagggacataccccagtaccggcagtgagcaataatgttcaatggcatttttgaggagctgatagtgggcgtcgctagtgacgcgattcacaatcacgcccgcgaggttgagggtcgggtcgaagtgctgaaatcccataacggtagccgcaagcgacgttgaaacagccttgccgtccaccagtaggatgaccgggcaaccaagctgtttggccatcgcggctgtgctgcagtaattggggtcgacgccatagccgtcatacaaccccatgaccccttcaatgacagcgatatccgcctgccgcatttgttcgcaaaataaggcgttgagaacaggaggaggaagcatgaaactgtcaagattacgggacgccacgccacagatagcggtatgccagccggtatcaaggtaatctggcccaactttaaacggctgtacgcgcagcgcgcgtttttgcagcagcctcaacaaaccaagcgtcaccgtggttttgccgcaaccgcttcctgtgcctgcaagaataaatgcgtgatgccttgccgccattaccctgatcctgttcagggtggtaggggtatacaggtacgcgcatgttcagtctttcgactgtacgcgtcttcgcaacccacttcccaccgaagttgttggttatcaccgacaggcaggtcttctggcttagcgtcctcctcgcccgtccttcccaatcttgcgatcagtggtctttacggggtcgtcagcatcacagcagcgggggctgcgggggattttcacccccttccctaccacaaatgtggcaaacctgttggtttacgttatggctgtacggcacacccataacgacaattaataatgtgctacgttttacatttctgtgagcaatagcctgagcggttgctcatctgacgttaatctactcatccttaccggtatattgacgataaaacgtatcgacaaagcgtaataaaacttatctttcctgacactgtacttcatcacaaaaataaaaactggtgcagtttatgccctaaattttattattttgttgcgctatgacaatttattgttacaccagataaattttctttctgaaatgattaagatacaaaagactatcaaaaatcggcaatagcaaaatattgctattcataacgatggaggatgagaattctcatttatctgctggcgataagcctgcggcgtaacctgataggtctggcggaagactttgcaaaaatagctggtttgcgaaaagcctaaattacgcgcaatactggcaatactccagtcactatggcaaagcaattctctggcgctaaccattctctggcggtttacccacgcattaaatccgattccctgatatttcttgaatagcttactgaagtaataggggctgagatagacatgtgaggcgacatcctcaagacgaagatcgtcggacaaatgcgcatcaatatagcgaagcgcttttttcattttactgtcatgcggagtgggaccacgagtggttttatttgcctccgattgctgcggattgtctttgataaccacgaaattgagctgttttttcaggcaattctcaacaatcagtttaagaagatcggcggaagcgataacgcgtgaatagtccatctctggcacattccgaaattcattcaagagctcagggtcagcctgccagcgatcgtcaacattaagaatgtttaccagctccacgtcattacttaaacgaacctgcccgcataaaacaaagccaactaaatgccctgcgattaccagcggaatagaaaaatccgttagaccggcatgacaacgataaatacagggttgatcggacttcgatgcctccagtcccccgcagcgatcgctcatacgacaacgtgtactatgctggggatgctgccgcatcaactgacaaaacggcgtgaaattgaatagctcagatatttcatcaccatgaatattgacaaccacaaccgccagaccggtggcttgtgcaaaatcctgtgcgattttattaatgagttctgagttcagagcgctcgcagaaatcatgataaaacccctcagttaatttattgttataaacaaaacacattatttacattcactttttattaccattatcctggccctgataaaaagtacaatgacaatatcaaaagtctcccattgctgggagacgttttgatcagttcgtgaaagcagatcacgaaattatctcacctgtttttacgatacatcattgctgtgaatctggttcgcatttccttacagttcacagcggttacaaggtaaattcttaccaataaaatagcgatatatggctgctccggcacaggcgccgataacaggcgcgacaatcggcacgataaaataagggatctctcgcccaccgctcatcgccatgttcccccaccccgctaaccatgtgaacagtttgggaccgaaatcacgcgccgggttcattgcaaaaccggtaaggggtccagtagacgcgccgataacggcaaccagtatcccaataagcaaaggcgcaagcggccctttaggaatgccattgccatcatccgtcaatgccatgatcatgcccatcagaatcgacgtaatgaccacttccaccaacgcagcctgccatacatttagcgctgcggccggataggtactgaaaatgctggctaattgcaaactttcgacgctaccgcgcaccatatgatgcgcagtctcaaattcagtaaaaaggctactataaagcacatacgccagcagagcgccgccaaaagcgccggcaaactgggcaataatataaggcaatactttctgtttggggaagcaggcaaacagccacagcgcaatcgtcaccgcagggttaagatgtccgccggagattccggcagtaaggtaaacggccagtgaaattccaagcccccaaataatgcaaatctcccataatccgaggctggcgcctgcgactttgagcgcgctcaaacaaccgataccaaaaaacaaaaagagtccggtgcctaaaaattccgcaccacattgcgcctttagagaatcattcatgtgacaccttctgagcaaagttcgtgtcctggccagcgcaagtttcggctggcggtagagtacagctaacctcactataaaaagtgccgcctgtaaattgttggcaacctgcgaacctgtctcccggaaaaatcgtgttgcgatagcaaaattttgcttttccgatatttttagcagcccatcatacgggagattcgagctataaaatacgcctgtgaaaataataaaatattgcacaagccaacttatcaatttcgaataagcatcacattttgcgtctttcgccatatcaaataaaaatactctcgtcactaacaaaaatgtaaaaatgaaataataaaaacaaaataatcatatagacaataataaattaaatgtaatttatcaataagttataaaagcaaaagacaatttagtcatattgctttcccattattttctgatgctcaacagcaagtcagccattctttttcctcgcatcttcttatagtcccaactatcggaacactccatgcgaggtctttatgcaacaagaagcactaggaatggtagaaaccaaaggcttaaccgcagccatagaggccgctgatgcaatggttaagtcagccaatgtgatgttagtgggctatgaaaagattggctccgggctggtaaccgtcatcgtgcgcggcgatgttggcgcggtcaaagcggccaccgatgcaggtgccgcagccgcacgcaacgtgggtgaagtgaaagccgtacacgtcatcccacgccctcacaccgatgtagaaaaaatcttaccgaagggaattagccaatgagcagcaatgagctggtggaacagatcatggcgcaggtgattgcccgtgtggcaacgccggaacaacaggccatccctggtcaaccccaacctatacgagagacggctatggcagaaaaaagctgcagtttaacggaatttgtcgggaccgccattggcgataccctgggcctggttatcgccaacgtcgataccgccctgctggacgcgatgaaacttgagaagcgctatcgttccatcggcattctcggcgcccgcaccggcgcaggcccgcacattatggcggcggacgaagcggtgaaagccaccaacaccgaagtggtcagcattgagctgccgcgcgataccaaaggcggcgcgggccacggttcgctgattattttaggcggtaacgacgtttccgacgtcaagcgcggtatcgaagtcgcgctgaaagagctggaccgcaccttcggtgatgtttacggcaacgaagccggacatatcgagctgcagtacaccgctcgcgccagctatgcgctggaaaaagcgttcggcgcgccgattggccgcgcctgcggcattatcgtcggcgctccggcttccgtcggcgtactgatggccgataccgcgctgaagtcagccaacgttgaagtcgtggcgtacagctctccggcgcacggcaccagctttagtaacgaagctattctggtgatttccggcgactccggcgcggtccgtcaggcggtgacctccgcccgcgaaatcggcaaaaccgtccttgcgaccctcggttctgaaccgaaaaacgatcgtccgtcctacatctgatacccacgaggctgattcatgagatcgaaaagatttgaagcactggcgaaacgccctgtgaatcaggacggctttgttaaggagtggatcgaagaaggctttatcgcgatggaaagcccgaacgacccaaaaccgtcgataaaaatcgttaacggcgcggtaaccgagctggacggaaaaccggttagcgaattcgacctgatcgaccactttatcgcccgctacggcatcaacctgaaccgcgccgaagaagtgatggcgatggattcggtcaagctggctaacatgctgtgcgatccgaacgtcaagcgcagcgaaatcgttccgctaaccaccgcgatgaccccagcgaaaattgtcgaagtggtttcgcatatgaacgtggttgagatgatgatggcgatgcagaaaatgcgcgcccgccgtactccatctcaacaggcgcacgtcaccaacgttaaagacaacccggtgcaaattgccgccgatgccgccgaaggcgcatggcgcgggtttgacgaacaagagacgacggttgcggtagcgcgctatgcgccgttcaacgccatcgcgctgctggttggttctcaggtaggtcgtccgggggtactgactcaatgctcgctggaagaagccaccgagctgaagctcggcatgctgggccacacctgctacgccgaaaccatctccgtttacggcaccgagccggtcttcaccgacggtgacgataccccatggtcgaagggcttcttagcctcttcctacgcctctcgcggcctgaaaatgcgcttcacctccggctccggctccgaagtgcagatgggctacgccgaaggcaaatccatgctgtatctggaagcgcgctgcatctatatcaccaaagccgcgggcgttcaggggctgcaaaacggctccgtaagctgcatcggcgtaccgtctgccgtgccgtcaggcattcgtgccgtgctggcggaaaacctgatctgctcttcgctggatctggaatgcgcctccagtaacgaccagaccttcacccactccgatatgcgtcgtaccgctcgcctgctgatgcagttcctgccgggtaccgactttatctcctccggttattccgcggtgccgaactacgacaacatgttcgccggttccaacgaagatgcggaagactttgacgactacaacgttatccagcgtgacctgaaagtggacggcggtctgcgcccggttcgcgaagaggacgttatcgccatccgtaacaaagccgcccgcgcgctgcaggccgtgtttgccggaatgggactgccgccgattaccgatgaagaagttgaagccgcgacctatgcccacggttcgaaagatatgccggagcgcaacatcgtcgaagacatcaagttcgcccaggaaatcatcaataaaaaccgcaacggtctggaagttgtgaaagcgctggctcagggcgggtttaccgacgtggcccaggacatgctcaacatccagaaagccaagctaaccggcgactatttgcacacctccgccattatcgtcggcgacggacaagtgctctctgcggttaatgacgtcaatgactatgccggtccggcaacaggttatcgcctgcagggagaacgctgggaagagattaaaaacatccctggcgctcttgatcccaacgagattgattaaggggtgagaaatggaaattaatgaaaaattgctgcgccagataattgaagacgtactccgcgatatgaagggcagcgataaacccgtctcgtttaatgcgcctgcggcatccacagcaccacagaccgctgcgcctgcgggcgacggctttctgaccgaagtgggcgaagcgcgccagggcactcagcaggacgaagtcattatcgccgtcggcccggcatttggcctggcgcaaaccgtcaatatcgtcggcttaccgcataagagcattctgcgcgaagtcattgccggtattgaagaagaaggcatcaaggcgcgcgtgattcgctgctttaaatcttccgacgtggcgttcgtcgccgttgaaggtaaccgcctgagcggatccggcatctccatcggcatccagtcgaaaggtactacggttatccaccagcaggggctaccgccgctctccaacctggagctgttcccgcaggcaccgctgctgacgctggaaacctaccgtcagattggtaaaaacgccgcccgctatgcgaaacgagaatcaccgcagccggtccctacgctcaatgaccagatggcacgcccgaagtaccaggcaaagtcggccattttgcatattaaagagaccaagtacgtcgtgacgggcaaaaacccgcaggaactgcgcgtggcgctttgataaaggataactccatgaataccgacgcaattgaatcgatggtccgggacgtattgagccgcatgaacagcctgcagggcgatgcgccagcagcggctcctgcggcaggcggcacgtcccgcagcgcaaaggtcagcgactacccgctggcgaacaaacacccggaatgggtgaaaaccgccaccaataaaacgctggacgactttacgctggaaaacgtgctgagcaataaagtcaccgctcaggatatgcgtattaccccggaaaccctgcgcttacaggcctctatcgccaaagatgcgggtcgcgaccggctggcgatgaacttcgaacgcgccgccgaactgaccgcggtaccggacgatcgcattcttgaaatctacaacgcccttcgtccgtatcgttcaacgaaagaagagctgctcgctatcgccgacgatctcgaaaaccgttatcaggcaaagatttgcgcagctttcgttcgtgaagcggcagggctgtacgttgagcgtaaaaaactcaaaggcgacgattaaggatttcgtatgcgatatatagctggcattgacatcggtaactcatcaacggaagtcgcactggcgcggcaagatgagactggcgcactgacgattacacacagcgcgctggcggaaaccaccgggatcaaaggcacgttgcgtaacgtgttcggcattcaggaagcgctcgccctcgtcgcaaagcgcgcggggatcaatgtcagagatatttcgctcatccgcattaacgaagccacgccggtgattggcgatgtggcgatggaaaccattaccgaaaccatcatcaccgaatcgacaatgatcggccataacccaaaaacgccgggcggagcaggccttggtgtgggtatcacgattacgccggaggagctgttaacccgcccggcggactcgtcctatattctggtggtatcgtcagcctttgattttgctgatatcgccaatgttatcaacgcctcaatgcgcgccggataccagattaccggcgtcattttgcagcgcgacgatggcgtactggtcagcaaccggctggaaaaatcgctaccgattgtcgatgaagttctgtacatcgaccgcattccgctggggatgctggcggcgattgaagtcgccgtgccgggaaaggttatcgaaaccctctctaacccttacggcatcgccaccgtatttaatctcaacgccgatgagacaaaaaacatcgtcccgatggcgcgcgcgctgattggcaaccgttccgccgtggtggttaaaacgccatccggcgacgtcaaagcgcgcgcaatacccgccggtaacctggagctgcaggctcagggtcgtaccgtgcgcgtggatgttgccgccggtgccgaagccatcatgaaagcggtggacggttgcggcaagctcgacaacgtcaccggcgaggccgggaccaatatcggcggcatgctggagcacgtgcgccagaccatggccgaactgaccaacaagccgagcagtgagattttcattcaggatctactggccgttgacacctcggttccggtgagcgtcaccggcggtctggccggggagttctcgctggagcaggccgtcggcatcgcctcgatggtgaaatcagaccgtctgcagatggcgatgattgcccgtgaaattgagcagaagcttaatatcgacgtgcagatcggcggcgctgaggctgaagccgccattctgggcgcgctgaccacgccgggtaccacccgaccgctggcgatcctcgacctcggcgcgggctccaccgatgcctccatcatcaaccctaaaggcgaaatcatcgccacccatctcgccggggcaggcgacatggtcacgatgattattgcccgcgaactggggctggaagaccgctatctggcggaagagatcaaaaaatacccgctggctaaggtcgaaagcctgttccacttacgccacgaggacggcagcgtccagttcttcccgacgccgctgcctcccgccgtgttcgcccgcgtctgcgtggtgaaaccggacgaactggtgccgcttcccggcgacttagcgctggaaaaagtgcgcgccattcgccgcagcgctaaagaacgcgtctttgtcaccaacgccctgcgcgcgctgcgccaggtcagtccaaccggcaacattcgcgatattccgttcgtggtgctggtcggcggctcgtcgctggatttcgaagttccgcagctggtcaccgatgcgctggcgcactaccgcctggtcgccgggcgaggaaatattcgcggcagcgaaggcccaagaaacgcggtggccaccggcctgattctctcctggcataaggagtttgcgcatggacagtaatcacagcgccccggctatcgtcattaccgttatcaacgactgcgccagcctctggcacgaagtgctgctgggcattgaagaggaaggcatccctttcctgcttcagcatcacccggctggagatatcgttgacagcgcctggcaggcggcgcgcagctcgccgctgctggtcggcattgcctgcgatcgacactcgctggtcgtgcattacaagaatttacccgcatcggcgccgctttttacgctgatgcatcatcaggacagtcaggcccaacgcaacaccggtaataacgcggcacggctggtcaaagggatcccctttcgggatctccatgcttaatcacaggagaacggcagtatgaataacgcactgggactggttgaaacaaaagggctggtcggcgccattgaagccgccgatgcaatggttaaatccgccaacgtacagctggtgggctacgaaaaaattggttctggcctggtgaccgtcatggttcgcggcgatgtcggcgcggttaaagcagccgtagatgccggcagcgcagcggcaagcgtcgtgggtgaagtgaaatcctgccacgttatcccgcgtccgcacagcgatgttgaggccattttaccgaaatcagcctaatcgatggcgaataaggagcaccgcgtgaagcaatcactgggattacttgaagtttgtggtctggcactggctatcagctgcgccgatatcatggcgaaatccgcttctatcacgctgctcgccctcgaaaagaccaatggttcaggctggatggtgattaaaattaccggtgatgtggcctccgttcaggcggctatcaccaccggtgcgcatttcgccgaacagtggaatggcctggtggcccacaaggttatcgccaggcccggagaagggatcctgctcgcagagacaccctccccctccgtcattgaacctgagcctgaagcgtcagagatagctgatgtcgtttctgaagcgccagccgaagaggccccgcaggaatcagaactggtcagctgcaatctgtgtctggatccaaaatgtccgcgccagaagggcgaacctcgtacgctttgcattcattccggcaagcgaggtgaagcgtaatggataaagagcttctgcaatcaacggtccgtaaagttctcgacgagatgcgccagcggcctattccgctgggcgtctcaaaccgtcatatccacctgtccgcacaggattatgagcggctgtttcccggccatcccatcagcgagaaaaaagcgctgctgcagccgggacaatacgccgcggagcaaaccgtcactctggtgggaccgaaagggcagctcaaaaatgtgcgcctgctcggcccgctgcgctcggtaagccaggtggaaatttcgcgtaccgatgcgagaacgctggggattgccgcgccgctgagaatgtccggcaacctgaaggggacgccgggcatccgcctggtcagcccctttgccgaactggagctgccttccggggttatcgtcgcgcagcggcatatccatatgtcgccgcttgatgcgctgatcctgcgggtttcccacggcgatatggtctccgtggcgattgaaggcgacgatcgcgggctgattttcaacaacgtggcgattcgcgtttcaccggacatgcgcctcgaaatgcacattgataccgatgaagccaacgccgctggtgccgataacccgcatgcctttgcccggctggtaggcccgcgatgaacggcgaaaccctgcagcgcattgtcgaggagattgtctcccggctgcatcgccgtgcccagagcacggcgacgctgagcgttacgcaacttcgcgatgccgactgtccagcactgttctgtcagcacgcgtcgctgcgcatcctgctcatcgacctgccgctgctgggtcagcttgcggatgcagaaaccggcgatgccgccgcccggaaaattcacgacgcgctggcgtttggcatccgcgtacagctcagcctgcacagccagctgctgccggttatcccggtaaaaaaactggctcgtctgccgctggtattcaccgatgagcacggactgccgctggttctgcatgcgggttcggtgctgagctatcgcgatgtcgcgctgctaagccgggggcgtgtggttgtccaccgcaaatgcatcgtgaccgccatggcgcgtgacgcggccaatgcgcggaatattcaattaattaagcaggagtaaatcatgcatctggcacgagtcacgggcgcggttgtctccacgcaaaaatcaccttctttgattgggaaaaagctgctgctggtgcgtcgggtcagcgccgatggcgaactccccgcctcgcccacctccggcgatgaagtggccgtggactccgtcggcgcgggcgtcggcgaactggttttgctcagcggcggctccagcgccaggcacgttttttccgggccaaatgaggccattgacctcgccgttgtcggcattgtagatacgctttcgtgttaaggggcggttatggcgatttatacccgaacaggtgacgctggcaccacatcactgtttaccggccagcgggtgagcaaaacccacccgcgggttgaagcctacggcacgctggatgagctgaacgccgcgctgagcctgtgcgcctgcgccgctgcggatgaaaaccaccgcaccttactcgaggccatccagcagcaacttttttggtttagcgcagagctggccagcgacagcgagcagccatcgcccaaacagcgctacatcagcagcgaagagatttcggccctggaagccgctatcgatcgggcgatggcccgcgtcgaaccgctgcacagctttattttacccggacgctgcgaagccgcgagccgcttacattttgcccgcacgctggcgcgccgcgccgaacgccgtctggttgaactggcaactgaagtcaacgtacgtcaggtgctgatgcgctatatcaaccgcttatcggactgcctgtacgccctggcccgcgcggaagatagcgatgcgcaccaggccaacatcatccgtgaagttagcaagcgctatctggctgcctgccagccgccccacagcaaggagacgacgccagtggccctctcattccacgatctgcaccagctcacccgcgccgccgttgaacgcgcgcagcaactgcaggttccggtagtcgtcagcatcgttgacgcgcacggcacggaaactgtgacctggcggatgccggacgccctgctggtcagcagcgagctggcgccgaaaaaggcctggaccgcagtggcgatgaaaacggcgacccatgagctgagcgatgtcgttcagccgggcgccgcgctttacggtctggaaagtcatttacagggaaaagtggtcacctttggcggcggttacgccctgtggcgcgacggcatattaattgggggtcttggcatcagcggcggcagcgttgagcaggacatggacatagcacagaccgccatcgcggctattaacgtgggaactcatcaatgaatacttctgaactcgaaaccctgattcgcaccattcttagcgagcaattaaccacgccggcgcaaacgccggtccagcctcagggcaaagggattttccagtccgtgagcgaggccatcgacgccgcgcaccaggcgttcttacgttatcagcagtgcccgctaaaaacccgcagcgccattatcagcgcgatgcgtcaggagctgacgccgctgctggcgcccctggcggaagagagcgccaatgaaacggggatgggcaacaaagaagataaatttctcaaaaacaaggctgcgctggacaacacgccgggcgtagaagatctcaccaccaccgcgctgaccggcgacggcggcatggtgctgtttgaatactcaccgtttggcgttatcggttcggtcgccccaagcaccaacccgacggaaaccatcatcaacaacagtatcagcatgctggcggcgggcaacagtatctactttagcccgcatccgggagcgaaaaaggtctctctgaagctgattagcctgattgaagagattgccttccgctgctgcggcatccgcaatctggtggtgaccgtggcggaacccaccttcgaagcgacccagcagatgatggcccacccgcgaatcgcagtactggccattaccggcggcccgggcattgtggcaatgggcatgaagagcggtaagaaggtgattggcgctggcgcgggtaacccgccctgcatcgttgatgaaacggcggacctggtgaaagcggcggaagatatcatcaacggcgcgtcattcgattacaacctgccctgcattgccgagaagagcctgatcgtagtggagagtgtcgccgaacgtctggtgcagcaaatgcaaaccttcggcgcgctgctgttaagccctgccgataccgacaaactccgcgccgtctgcctgcctgaaggccaggcgaataaaaaactggtcggcaagagcccatcggccatgctggaagccgccgggatcgctgtccctgcaaaagcgccgcgtctgctgattgcgctggttaacgctgacgatccgtgggtcaccagcgaacagttgatgccgatgctgccagtggtaaaagtcagcgatttcgatagcgcgctggcgctggccctgaaggttgaagaggggctgcatcataccgccattatgcactcgcagaacgtgtcacgcctgaacctcgcggcccgcacgctgcaaacctcgatattcgtcaaaaacggcccctcttatgccgggatcggcgtcggcggcgaaggctttaccaccttcactatcgccacaccaaccggtgaagggaccacgtcagcgcgtacttttgcccgttcccggcgctgcgtactgaccaacggcttttctattcgctaactgaggtcgcgatgaataccttctcactacaaacgcggttgtacagcggtcagggcagcctggcggtgctcaagcgctttaccaataagcacatctggataatctgcgatggctttctggcgcactctccgctgctggataccctgcgtaacgcgctgcccgcagataaccgcatcagcgtctttagcgagataacgccggaccccaccatccacacagtggttcagggcattgcgcaaatgcaggctctgcaaccgcaggtggtgatcggttttggcggcggctcggcaatggacgcggcgaaagcgattgtctggtttagccagcagagcgggatcaacatcgaaacctgcgtggcgatcccgaccaccagcggcaccggctcggaagtgaccagcgcctgcgtaattagcgacccggataaaggcatcaagtatccgctgttcaacaatgcgctgtatccggatatggcgatcctcgacccggagctggtggtcagcgtaccgccgcagattaccgccaacaccggcatggacgtgctgacccacgccctggaggcctgggtgtcaccgcgcgccagcgactttaccgacgcgctagcggaaaaagccgccaaactggtgttccagtatctgcccacggcggtggaaaaaggcgactgcgtggcgacgcgcgggaaaatgcacaatgcctcaacgctcgccgggatggccttcagccaggcggggctggggcttaaccacgcgatagcccaccagcttggcgggcagtttcatctgccgcatggcctggccaacgccctgctgttaaccacggttatccgttttaacgccggcgttccgcgcgccgccaaacgctacgcgcggctggccaaagcctgcggtttttgcccggcagaagccaatgatatcgcggcgatcaatgcgctgattcagcaaatcgaactgcttaagcaacgctgtgtccttccctcactggccgttgcgcttaaagaaggaagatccgacttttccgcacgcattccggcgatggtgcaggctgcgctggctgacgttacgctgcgcactaacccgcgcccggccaatgccgaagccattcgggaactgctggaggaactgctatgagcaccgccatcaacagcgttgaaatgtcccttagcgccgatgaaattcgcgagcgcgttcgcgcagcgggcgttgtcggcgcgggcggcgcaggttttcccgctcacgtcaaactacaggcgcaggtagagatttttctggtgaacgccgccgaatgtgaaccgatgctcaaagttgaccagcaactgatgtggcagcaagctgcgcgccttgtgcgcggcgtacagtacgccatgacggcaaccggcgcgcgcgaaggggtgatagccctgaaagaaaaataccgccgggccatcgacgccctcaccccactgctgccagacggtatccgcctgcatatcctgccggatgtatatccggcaggcgatgaggtgctgactatctggatggcaaccggtcgtcgggtcgccccggctgcgctaccggccagcgtcggcgtggtcgtcaataacgtgcaaacggtgctaaatattgcccgagcggtcgagcagcggtttccggtcactcgtcgcacgttgaccgtgaacggcgcggtcgccagaccgttgaccgttactgttcccatcggcatgtcgctgcgggaagtactggcgctggcgggcggcgcaacggtcgacgaccctggttttattaacggcggcccgatgatgggtggcctgattacctctcttgataatccggtgacgaaaactaccggcggcctgctggtgctccccaaaagccatccgcttatccagcggagaatgcaggacgagcgcacggtgctttccgtcgcgcgcaccgtctgcgaacagtgccgactgtgtaccgatctctgtccgcgacacctgatcggccacgaactctctccgcacctgctggtgcgggcggtgaactttcatcaggctgccacgccgcagctgctgctgagcgcccttacctgttcggaatgcaacgtttgcgaaagcgtggcctgtccggtggggatctcgccgatgcgcatcaaccgcatgttaaaacgcgagctacgggcgcaaaaccagcgctacgaagggccgctgaatccggccgacgagatggcgaaatatcgcctcgtgccggtgaagcggctgatcgccaaactgggactaagcccctggtaccaggaagcgccgctggttgaagaagaaccgtcagtagaaaaagtcactttgcagctgcgccagcatattggtgccagcgcggtagcgaacgttgcggtgggagaacgcgtgacgcgcgggcaatgcgttgctgatgtcccgcctggcgcgctcggcgcacccattcacgccagcatcgacggcgttgtatcggccatcagcgaacaggccatcactgttgtaagaggttaaccatgtctcaggctataggaattttagaactcaccagcatcgccaaaggcatggagcttggtgatgccatgctgaaaagcgccaacgtcgatctactggtcagcaagaccatctgtccggggaagtttttactgatgctgggcggcgatatcggcgctatccagcaggccattgaaaccggtacgtcgcaggccggcgagatgctcgtcgacagcctggtgctggcgaatattcatcccagcgtacttccggccatcagcggcctgaacagcgtcgataagcgccaggcggtaggtatcgtcgaaacctggagcgtggcggcctgcattagcgccgcagaccgggcggtgaaaggctcaaacgtcaccctggtgcgggtgcatatggccttcggtatcggcggtaaatgctacatggtggtggcgggcgacgtttctgacgtcaataacgccgtgacggttgccagcgaaagcgcgggcgagaaagggttgttggtttaccgttcggtgatcccacgcccgcatgaagccatgtggcgacagatggtggaggggtaatggaaagacaaccgacaacggatcgcatgattcaggaatacgtgccggggaaacaggtcactctcgcgcacctgattgctaatccagggaaagatctctttaagaagctgggcctgcaggatgcagtgtccgccattggcatccttaccatcacgccgagcgaagcatcgattatcgcctgcgatatcgccaccaaatccggcgcggtggaaattggttttctcgatcgctttaccggtgccgtggtgctgaccggcgacgtttctgccgtcgagtatgccctcaagcaggtaacgcgcacgctgggcgaaatgatgcagttcaccacttgctcgatcacccggacgtaaagtcatgaagcgtttgatgtttatcggccccagccagtgcggaaaaacctcgctgacccaaagcctgcgcggcgaagcgctccattataagaaaactcaggccattgaatggtcgccgatggccatcgatacgccgggcgaatatctggagaaccgctgcctgtacagcgccctgctgaccagcgcctgcgaggccgacgtcatcgccctggtgctgaatgccgacgcccagtggtcgcccttttctccgggttttaccgccccgatgaaccgcccgacgattggcctggtcaccaaggccgatctcgccgagccgcagcgtatttcgctggttgcggagtggcttacgcaggctggcgcacagcagatttttattaccagcgcgctgaataactcgggtctcgacgccgtgctggattttctgaattcgaaggaacctttatgtcttacaaaataatggccattaacgccggtagctcatcgttaaaatttcagctgctggagatgccgcagggcgacatgctctgtcaggggctgattgagcgtatcggtatggcagatgcgcaggtgacaattaagacgcacagccaaaaatggcaggaaaccgtccccgttgccgatcatcgcgatgcggtaacgctgcttctggaaaagctgctgggttatcaaatcattaacagtctgcgggacattgatggggtgggccatcgtgtggcgcacggcggtgagttttttaaagactcgacgctggtcacggatgaaacgttagcgcaaatcgaacgtcttgctgaactggccccgcttcacaacccggtaaacgcgttgggtattcacgtttttcgtcaactgttgcctgatgccccttccgtagccgtgtttgatacggcatttcaccagacgctggatgaacccgcctatatttacccgcttccctggcattattacgctgaactggggattcgccgttatggctttcatggcaccagccataagtatgtcagcggcgttctggcggaaaagctgggcgtaccactcagcgcattacgggtgatttgttgtcatcttggaaacggtagcagcatctgcgccatcaagaacgggcgttcggtcaatacgtcgatgggctttacgccgcagtcaggcgtgatgatgggcacccgtagcggagatattgatccctctattctgccgtggatagcccagcgcgaaagcaaaacgccgcaacagttgaatcagttattaaataatgagtcaggcttgctgggcgtttctggcgtgtcgtctgattaccgcgatgtcgaacaggcagccaataccggtaaccggcaggctaaactcgctctcactctgtttgccgaacgcattcgcgccaccattggcagctatattatgcaaatgggaggactggatgcgctggtattcactgggggcattggcgagaactcagcgcgcgccagatcggcggtgtgccataatttgcaatttttgggcttagccgttgatgaagagaaaaatcagcgtaatgcgacatttatccagacggagaacgccctggtgaaagtcgccgtcatcaacaccaacgaagagttaatgatcgcacaagacgttatgcgcattgcgctaccggccacggaagggctttgtgtaccagcctgagagggttatacgacgcattgcggcaagtcatggtaataacgcttttaccatgacactatgcgcgcacactattcgtacctgaaaggtgataatgtggctgttgcgcaatgccccgcctcatgcggggaacttatccagggatggattctgggcagtgagaaactggtctcctgccccgttgactggtacagcaccgtagcagtcacggctgcgccgccgttgataaacgagcgcccattgtcgcgggcgatggtggagcgcgttctggcgcactggcagtatcctgcgcactggagtaacgagattcgcgtcgatgtgcgttcgtcaattcccgttgccaaaggcatggccagcagcaccgcagatattgccgctacggcggtggcaacggcgcatcatcttggccattcgctggatgaaaccacccttgcacagctttgcgtctcaatcgaacccactgatagcaccgtttttcatcagttaacgctgtttgatcataataatgcggccacgcaaatcgcctgcgagccaccgccgccaatcgatttgctggtactggaaagcccggtcacactgcgcacgcaagattaccaccgtctccctcgccagcagaaattaatagcaagttcagcaaccttgcagcaggcctggaatctggtgcaggaagcctgtataacgcaaaatccgctccggctgggtgaggcggctacgcttagcgctatcgccagccagacgctgttacctaagccgggctttaccgccctgctgtcgctggtcgaagagtgtgatttatacggattgaacgtggcgcatagcggtagcgtggtgggtctgatgctggaccggaaacgtcatgatattgcgcgtctgaaaggtaagctggcagagaaaaaacttacccgacactggccaaaacaacatttactcaagatggtcactggcggggtcaaactgcagtgagagcctgatatacgctcccactgccgtagcgcattattcggcttttacatcggcgtgtttcatttcgcccatcgctttcagctttttggaaatgtcgcgacgctctttggagatttcggcatttttaatgatgtagtcatcaacgcgatcttcatagtcgcttttcatactggcgatgataccctgaatcgcctcaacgctcatacctggcttgatgtagtcgctcaggttgtccagcagcagcacacgcttctggttgtcacggatcttcttctcaatgtcctgaatttcacgctgcagtttatttttgcgacggaacagacgaacaaactccagcacgtcctggaaagaaggcttggttgtttccatttttacacccctgataatgtgagattcggattcgttaagcaactgctagtggataaacattacgtttatccccgtcatacttcaagccgccagaggaaacaccgttacgtcgccgtctggggaaacctgaaggttcggggataaaatcgttgccagtagcactcattttatccttatattagtatcatactcttaatctttgctgaatcgaagcagcaacaaattcattcgccccatctgctttttatttgcgcaaagcccggcagatcaaatgtgaaagcagttccaactgtcgggcagtttccatacttagccaaacatagccgtggataggggtttcagccaccgcgtcgccctgctgctcgttcattagctgccgcaactcggcagcaatatcattcagtttaccggtgtttgccagtaccggctgcgggttgccttcaaacaacgcgtgggcgatcgttagcaaggtttgctgcgtcatctgctgggtttcacgcaatgtgtgcgcgttaagcatcacaaaatggctggcgcgcgtcgcccagtgggcattgatttgtaattcaagcatacaaaccaggttgcggttgatggtctgaatggcctcgaaaatagatttttgtatccgggtttctttactggcaggcgttatcagcccgcgcattttgacgacatcgttcagcaaccgttgcaaatgtttatccaaccgggggcgctccagcaaattcggcgacagcgctgcctgatacacccgattatacgccgtgacgcaatgcgccagttggatgcgccagtgcaaaaaggcgcgctggggccagatgccggtaaacaacattgccagtagcgaccccaaaatcacatccccgccacgccataatgccgtatccatatcaccagcgggagcgccgacaacaacggcaagcgttatgcctatcagtagcgcctgatacggttttttccctaaggccagccagccgcacaaaaacatcgctatcgcacaccacaccagcatcagcggtaaggaaaagagctccaggcgtagcgccaccagccctaacgccgcgcccagaatcgtaccgcctatgcgctcaaaagcacgaggcactacatttccccagaatgagatgggccccataatcaccactaacgtgattagcggccatgtgccctcgggaatagaaaacagacgaaccagcagaaaggtaagaatgaacgccagggcgatacgtatgccatgcacgatgcgataatgacggtacaaccgtatttcaaaagggcttaatgacttatcggcacgcacgcttgcgctccttacgggaatggcaaaaaatgcattgtacctgctttatagcaaaaatagcgcactggcggacggaacacattatccgtccgctcttttcagccaggaaaccagtcgatcacttccgctgtaccggaatatacatttcaatatcccagtatccatcttccatgccgttattcagataggtttcaaaacagggcgcagaggctatctgataagcgctatcctgctcgaggacatcaaaaaaccgttcccacggcttcgcaaagtcacggtcttccactcgcgcgacagcagtggcatattcgccgccttcaatggcggtcacgattacgccttcgctattgtccggcaggatgaaattctctgccacggacaccacggtatcgcagcggagtttttctgcaggtacgacatctggattgtcgtaatagacggcaatccattcaactggcacgatccgctgtcgatccacccacgtcatcagttgttcaaaaccctgcttcacggtgtgttcccatggaccgaccatgtggaaaccggctatcttgcgtttttgttcctgcctgatttcgtaatccatgctgcctccgtcacttcacaatgctgtatgaatgtacagtataattacagccttttacggtcacaaggacagcgtgatcattttgtgagcaacctcgcaatcccgcccttttgacacctcagatgacggtgaacggtgtgtgtgacaacggcttacgctttatgctgaaaatagtcgctcagacgagagaacataccgcctttacccaccgattccagagtgaccagcggccactgagcgatcagtttatcccgatcgtagagctctatttcacctacctgttgatgagcggcgattggcgcctccagctcttttctatccagcacatattttgctttgatatgcggaatttccgctttaggcagcgccatccagaagtcctgttccgtacccagcgcaatcttttctttgtctccataccagattcgctcgctgcccacttttttaccgctgtgcaaaatctgcaccgtcgcaaagttttgctggccccactgcaacagttttcgcgcctgttcctcacgacctttcgaacttttcgcccccatcacaacggcgataagtcgacgctgcccgtccaccgccgatgcgataagattaaatcccgcccccgatgtgtgtccggttttaagcccatcgatatgcatggtcttatcccataacaagccgttacggttctgctgcgtgatgccgttccaggtcaggcttttctcgctgtacatgtgataaaattcaggctcgccgtgaataatcgcccgggagagtacggccaggtcatacgcggagctatgttgtcccggcgcatccagaccgtggacggtttcaaaatgggtatcctgtaaattgagttttttcacatagctgttcatcatcgccacaaactgcggctgcccgcccgcgatataatccgccagcgccacacaggcatcgttaccggaatccacgattaagccacggcttaaatcacgcaccgacacgcgatccccttcttttaaaaacatcaacgaggagccgacaaacaccggattatccttcgcccaggcgtcgcgcccaactgtgacgatatcgtcagggctgatacgatgactatcgatggcgcgatcgacgacgtagcccgtcattagcttggtaaggctggcgggattacgttgctggtgttcattaccggcggtaagaacctgtcccgtagtgtaatccatcaacacccaggcgcctgcatcaatggctggcggttggggagcaaaacttacggcatcggccgcaagcgcaggagaaaggtgcatcgcgaataaagaagcggcaataaacaaacggcgtttcaacagcatgtcctcaggatggtctctatttgccgttctttttacggaagttcagttaaacaaacatggataaattgcaagaaaatgtgacacaaggcacattttcttgctgacattattttatggatacgctcagacggcggacttatccccgcgcggcgcggtacgatgacgatgatagccgtcaaccatgctacggaaaatttgtcccggcgtgtcgccaagagtacacagatagagatgcgcgcaaataaacagtaagccgatgatagcaagcgccatatgcagcaccagcatcacagggcccagacccgcaacctgcggatagagacacagcaaaccggtgatgattaacagcggtaccagcgcgtacataatcgccagatatgccagttgttgcagtggattgaacttattctgctctgttgccacgaacggatgcgcttcccctttcataatgccaaaaaggtaaaaacgcgtctggcgtatgcagcgcgttaccagtccggaaaaatttacccgatagtgacgcccgttacctgtggtgaggttgatcagcacaaacccgacccagaaagccagtaaggcaaaaccacaccaggtatgcacttgtaccattagcgctacagggccgagagaaaaatgaccaaataaaccgcttaacagtaataaaacaaacagtaacgcatttccccaatgccagcggcgaatcgccagcgagtagagatagtcacgatgttcttcaccgcccgccgtttttggcgccagcatccggcgcaataacgcatggataaccagcccaacaagcatgagcagcaccacgacgcctgcgtaaattaaccacagcggccaataatctggcgcataatgtagttccgctccccagatagtattcatgctttaccctcctgatggacttctttacgacggtacagactgaccgcgccgctacgcgcctcctgctggcgatagacctctttctgaccgacccagcgctggatctcgctctcatccagtctgccgaatttcagcgcgtccgttgggcaaacggatacgcacgccggagactggccagccgccaaccgcgtgtcggcgcagaagttacacttgtcggcgacaccggtttgcggattcaaatagcgcacatggaaaggacacgcggcaacacaataatcgcagccaatacagcgcgatttatccacctgcacgatcccgttttcatcacgatatgacgctccggtaggacaaacgctgacacatggcgcattttcacagtgctgacaggagacgcggacaaattgaaaatgggttagtgcgttggatgcctgttcaggggcgcgaatttgtacctgtacgcggctaaatccctccggtacgtcattaagcactttgcaggcaacggtacacgcctggcagccgatacaacgtttttcatcatgcagcatgacgtactgattcgttaaatgattcatggttccctcctccctcatgcccggctcagcgtcacgcctgcggtatgcactaccgtaccggataccggactcgtcacgtgcggcagtaaatttccgcagtggataccgtgtgtcgtcgccgccgttttggccccagctttagcgccaaatcccatatagacaaaaagcgtgtccgggcggataccgggcgtcaccagcgccttacctttctctttacccgtggcattttccagccagatctcatcgccggtcttaatgcctttttcttgcgccgtttgcggatgaacccagaccgcgttatcccacattagctcgctgagtaaaggtacgtactgcgtcgcgccattggtatgcacggccaccttgccctgaatgaagtaaagctcattctcttttttcagcgcaaagtcacgaacgcgcggaacgccgtagccagggagcaattcctccagggttgcggaataaagttcgattttgccggagggcgatttgaagcgaagctgttcgccataggtgttgtcactgtccgtcgcgatagcgccggggtaacgcgccgtaaactgacgaacggattctggttcgcgtaatagcagcggaacgccccattcgagataccctttctgtcgcagttccttcgctaaggcatggtcgccgttcaactgatagagttggcgcgtctgcatatcctgccacggatagtactgccctaatcccaactgctcgccaagttctttccagatttgccaactcggacgcgcctcgccaatcggctctacgacctgttggcgcagagcgtaagccgggtgcagtcccgacatatcggatacctcttcgtcccgttcgagataggtgcattccggcagcagatagtcggcatatgccgcgctctcgctcaaatagacatcgcagctgaccaccagatccagttgctcaacggtttttaccaggtccgaacgacaggtgacggtctggaaaggattatgccgcgacataatccacgcctttatcgggtaaggcttctgggttaacgccgagtcaataatgctttgcaccacgccgccgccagcggcgatatatttaaactgcggtgcgaccaaatcgatgcgttgcgccgtcggtttcggcatatttttaatgttgagtttcgccagcgttggcgcgaccttttctccggccagtttattgtaaacagacgcgttttttttctgatatagcccgccttcgcgctcaatattaccgagcagcacattaagcgtaaaaatcatacgccgcatatcgatctcttcctgcgagaacgtcgcgcgatgaccaggactgacaatagcgtgaggcgcgcaggcagccagttcgcgtgtcacccggacaataacgtcggctgggacatcggcctgcgcggcggcccattccggcgtcgtctcttttaccgcctgtgctaactgttcaaatccgctggtataacgctcaacaaaagacgcatcgtagagctgttcatcaatcatgacgtggcacatcgccagcagaaccgctaaatcccccccgggacgaatagcgtgccactcatccgccttgctggaaaatatcgacaaacgcggatcgaagctcaccattttggcccccttctcctgcgcggtcattaactcatgggtatcggcaacttcaatcccttcatacaaattgtggccaaacgaaaccagatagcgcgtgttagcgatatccatcgccagatcgccgcccatcatcacttttgccgcaatggctttcccggcagggcatgttgaggcgtgcgtaaaggtattaggcgaaccaaaggccgtagccagatggaaaagatggctggagagcgagcccgatttggaagagaaagccacgctctcggggccatgctgcgctttgatggcattcattttcgccgcgatttcctggtaagcctgttgccagctaatcacctgccattcaccgtcgccgcgtggcccggtgcgtttcataggttttacaatccgttgcgggtcattgaccaggctgacgccgctcccgcccctggcgcatatgcgcgtcccctgctgcggcgcagaaggattgccctggataaaaacggtcttgttattgactacctgcgcctgaatagggcaacgaaaggaacacatttcgcacaagcttggcgttagcgtggttttaccgttaatgccggcaatcgggttgcgcgccagcgccccgggcggaaaagcgcccagcgcgcaggcagagcagccgatgcctaccccctgcaaaaaagaacgacgactaatgctcatataacctcctgttattagatatagctgaagattatatttaatttgtattatgaaatgtcggcttcaatcacaatttgaaatagttgttaaaatgagcatgtcaacacgataaaaccttttattttataaatattttacatttcctgaacacgcacatggactgtcattgaataatcagcagaattaccaaacaacccgctgttaattataaaaatgatacaattccaataacacgtaataatatttaaaagaaaacgattatttcctgaaaagcgatttcacgcgctttacgcagttctttctcatacgcgccggaacgtccgccgacgatatcccgaatgccggcgaaaaacgctggttgagcatcgaagcgggtttacttttgcgtgcacacgggcttcgttacccgacccgctcccttatgccttgatttttccgcagatacgtcagcgtcccacaatacggtgacatgatgacaggatggacactttctgaaagaaacctgccagataacatggtgaattgtgatctccatcgccataccgacatatgaagcttacttttaaggcgttaaaaatccagaccgtttttccataatgatgttgataaggaattctaatgaagatatcatcaggcgcaattaatttttctactattcctaaccaggttaaaaaattaattacctctattcgtgaacatacgaaaaacgggctcacctcaaaaataaccagtgttaaaaacacgcatacatctttaaatgaaaaatttaaaacaggaaaggactcaccgattgagttcgcgttaccacaaaaaataaaagacttctttcagccgaaagataaaaacaccttaaacaaaacattgattactgttaaaaatattaaagatacaaataatgcaggcaagaaaaatatttcagcagaagatgtctcaaaaatgaatgcagcattcatgcgtaagcatattgcaaatcaaacatgtgattataattacagaatgacaggtgcggccccgctccccggtggagtctctgtatcagccaataacaggcccacggtttctgaaggtagaacaccaccagtatccccctccctctcacttcaggctacctcttccccgtcatcacctgccgactgggctaagaaactcacggatgcagttttacgacagaaagccggagaaacccttacggccgcagatcgcgatttttcaaacgcagatttccgtaatattacattcagcaaaatattgccccccagcttcatggagcgagacggcgatattattaaggggttcaacttttcaaattcaaaatttacttattctgatatatctcatttacattttgacgaatgccgattcacttattcgacactgagtgatgtagtctgcagtaatacgaaatttagtaattcagacatgaatgaagtgtttttacagtattcaattactacacaacaacagccctcgtttattgatacaacattaaaaaatacgcttatacgtcacaaagccaacctctctggcgttattttaaatgaaccggataattcatcacctccgtcagtgtcagggggcggaaattttattcgtctaggtgatatctggctgcaaatgccactcctttggactgagaacgctgtggatggatttttaaatcatgagcacaataatggtaaaagtattctgatgaccattgacagcctgcccgataaatacagtcaggaaaaagtccaggcaatggaagacctggttaagtcattgcggggtggccgcttaacagaggcatgtatccggccagttgaaagttcgctggtaagcgtactggcccaccccccctatacgcaaagtgcgcttatcagcgagtggctcgggcctgttcaggaacgtttttttgcccaccagtgccagacctataatgacgttcccctgccggctcctgacacatattatcagcagcgcatactgcctgtgttgctggattcgtttgacaggaacagcgccgccatgaccactcacagcggactctttaatcaggtgattttacactgtatgacaggcgtggactgcactgatggcacccgccagaaagctgcagcgctttatgaacagtatcttgctcacccggcggtgtctccccacatccataatgggctcttcggcaattatgatggcagcccggactggacaacccgcgctgcagataatttcctgctgctttcctcccaagattcagacacggcgatgatgctctccactgacacgctgttaacaatgctaaaccctactcctgacactgcatgggacaacttttacctgctgcgagccggagagaacgtttccaccgcgcaaatctctccggtagagttattccgtcatgactttccggtgtttctcgccgcatttaatcagcaggccacgcagcgacgctttggggagctgattgatatcatcctcagcactgaagagcacggggagctgaaccagcagtttcttgccgccacgaaccagaaacattccaccgtgaagttgattgatgatgcctcagtgtcgcgtctggccaccatttttgaccccttgcttcctgaaggcaaactcagcccggcacactaccagcacatcctcagtgcttatcacctgacggacgccaccccacagaagcaggcggaaaccctgttctgtctcagtaccgcattcgcacgctattcctccagcgccattttcggcactgagcatgactctccgccggccctgagaggctatgcggaggcgctgatgcagaaagcctgggagctgtctccggcgatattcccatccagcgaacagtttaccgagtggtccgaccgttttcacggcctccatggcgcctttacctgtaccagcgttgtggcggatagtatgcaacgtcatgccagaaaatatttcccgagtgttctgtcatccatcctgccactggcctgggcgtagtccagcctcaacccgcatggaattaagggacacagcgttgtgtccctctgtacatagacccgttttagtccatgcattttttgagatcccggccagattgcccctggcctaaattccatacagtactaaatcagaatcagtaatttcagatggaccggaatatggtttaccatagagggagcgtagtttagtgtcgctgatgatcattttagtattttgtactcaccatcgcatgtacgaacattagcaacaatatcaattggtgtacaaatacaatcaatcaacgacaaaataaaagaataaaatatttcatatacatataacatcaggcgtgtacatcaagtgacagttaaaaacgacagcatacagagcacattcctcttccacgattacgaaaccttcggtacgcatccagccctcgacagacctgcgcaattcgccgcgctccgtacggataacgacttcaacgttattggcgagccggaggtgttttattgcaaacccgccgatgattatctaccgcagcccggcgcggtgctgattaccggcatcacgccgcaggaagcgcgtgagaaaggagaaaacgaagccgctttcgccagacgcattcatgcgctgttcaccgttcctaaaacctgcgttgtgggctacaacaatgtgcgctttgatgatgaagtcacgcgcaatattttttatcgcaacttttacgatccctacgcctggagctggcagcatgataattcacgttgggatctattggatgtcatgcgcgcctgttatgcgctgcgcccggagggaattaactggccggaaaacgacgacggcctgcccagctttcgtctggaacatttaacccgggcgaacgggatcgaacacagcaacgcgcatgatgcgatggcggatgtctacgccactattgcgatggcgcaactggtgaaaacacgccagccgcggctgtttgattatctttatagccaccgcagtaaacataaactggcggcgctgattgacgttccgcaaatgaagccgctggtgcatgtctccggcatgtttggcgcgtggcgcggtaatacaagctgggtcgcgccgctggcgtggcatcctgaaaaccgtaacgcggtgatcatggtcgatttagcaggcgatatttctcctcttcttgagctggacagcgatacccttcgcgagcggctttatacggccaaagccgatcttggcgatcacgccgcagtgccggtaaagctggtgcatatcaataaatgtccggtactggcgcaggcgaataccttgcgcccggaggatgccgaccggctgggaattaaccgccagcactgcctggataacctgaaagtgctgcgtgaaaacccgcaggtccgcgacaaagtggtggcgattttcgccgaagccgaaccttttgccgcctcggataacgttgatgcccagctctatgatggttttttcagcgatgccgatcgcgcagccatgaaaatcgtactcgaaaccgagccgcgtaacctgcccgcgctggatattacctttgtcgataagcgcattgagaagctgctgtttaattaccgcgcacgcaattttcccggtacgctggatgacgcagagcagcagcgctggctggagcatcgccgtcaggtgctgacgccggagtttttacaacagtatgccaatgaattgcagatgctttctcagcagtatgcggaagataaaacgaagctggggttgctgaaatcactgtggcagtacgcaaccgagattgtgtaattgaccaatgcctgacgggcattgttaatccagagcggataaatagtgacgccgccatccggtaaacatgctggatgacaaacaaaaaaccggaggcactgcctccggttttactattgccgataatacgcgcgattacgcgacgtcttcgtactgtggaaccgggttgcggaagcttttagttacgcacgccagataaatcagcccgatacccgcccagatcaggcccagtaccattgagctctcttccaggttaacccacaacgcaccaaccgtgagcgcgccgcacatcggcaggaacagatactggaagtgatctttcaacgttttattacgcttctcacggatccagaactgcgaaatcaccgacaggttaacaaaggtaaacgcgaccagcgcaccaaagttaatcagcgctgtcgccatcaccaggtcaaaattaatcgccagcagcgcgatcgccccgaccaggatgatgttcatcgctggcgtacgccatttcggatgaacgtaaccgaagaagcttttcgggaatacgccgtcgcgccccattacgtacatcaggcgcgctacgcctgcatgcgcagccataccggaagccagcacggtgatagtagagaagatcagcgcgcccacctggaaggttttacccgccacgtacagcatgatttccggctgagacgcatccggatctttaaagcgagagatatccgggaagtacaattgcaggaaataggttgcaaagatgaagatcaggccgccaatcagcgcggtcaggaaaatcgcacgcgggatcacgcgctcagcatctttggtctcttccgacaggttactgatgccgtcaaagccggtaaaggagaagcacaggatcgtcgctcccgtaatcatcgggataacgtgcgcatcgccggaccagaacggacgggtgctcgccagcgtaccggcgccttcgccttcaaatacgccataaaccaccatgcccagaatgaccgcaatcagcaccacctgtagcactacaatcacggtgttgaagttagcgaccgatttgaggctgcgcaggttaaaggccgtcataaaggccaccagcgccacaacaaacacccatgacggaatggagggcaccagcgcttcaaaataaattttcgccaacagaatgttgatcatcggcgcgaacagataatcgagcagagaagaccaacccaccataaagccaacggtcgggctgatggatttctgggcataggtatacgccgaacccgcggaagggtagcgacgcaccagtttcccgtagctcaacgccgtaaacagaatcgcgattaacgcgaatgcatacgccgtcggtacgtgaccgtcagtgaggcctgaaacgataccaaatgtatcgaacagcgtcatcggctgcatataggcaagacccatcattacaaccggaactaacgtaagcgttttacgtaattccacgcgagaggtgtttggagtaacgttatgcgacatggtcattctcctttacggcgaatgccgtcgcgtaagcaaaaaattgccccattttctggattcctcagcgacaacaactgtcgatttttaagtaagtatctatccggtacgaagcccggcctcttggtattgaatgatgtgtttgaagcaaaaaaataaccgacgcgtattaaaacgtcggttagtgtcattttttgcaagcggcgtattctgccctaaattgaagtgaaatgacaagagaatgcgagcgcgttcaaaaaattatttttcataagcgattgatttttaaaccggcgattttgcatacaccccagcaatagcattatttgctaaaatttcatcccgccaccagccactggccagcccggcggtctgttcattccagccaacccacaccggttcatagacgatttgcgccacaactttcttctctataagcgcgccgctttccaaaaatcgctgcgccagataacgcggtaaatagccgcatcccaggccgctaatttgcagctccagcttggttttaaaatcaaacacggtaatcgcttcctgagcgtcgagcagttcagaccctattgatcgcgaggaatggacgctatcgccaaccacaatcgcacgaaaacgtttgatcgtctggcggctaagcggttcctcttcatgaaccagcggatgatgaggggcgacggcaaacaccagttcaaggtcgcccagtcttgcaaagccaaagccggtgtcaggcggcggcgcgcgcatggcgccaacaataatatccgcccttccctgcgtcagcgtctcccatgaaccgccgagaacgccattaacaaatttaaggcgcgttacgctgtggcgttgataaaaagcgtcgataagcggggccagaagagaaaagggaaaggtatcatccacaccgatgaccagttcgttctcccagccttcatgcagtttaatcgcctgcttttccagctcgcgaacggtgtgcagcacttcacggcctttttccagtagcatcttaccggttcgcgtaaatcgcgcgcgatgcccgctacggtcgagcagttggatattaagatcgttttccagcttatgaacggtataactgagggcggacggcgttttaaataattttgccgacgccgccgcgaagctgccttctttttctaacgcatcaagaataatcagaacgtccagcagtggtttcatactcgtccccttgcgctatatggcgaccacctgctggacagcgactcactccatcggcatcaccaacggatcgggatattgatattcaaatcccagctcattacaaatccggctaccgtcgataatcttccctttgccgttgtccggtgcgtcacgaaaatgcggcggcgccattcccagcaagcgcgtcatttgcggataaaacacgttgcgggctggatgcgccggcgcacatatattatagatgtgccctcctttcggcgcctgtagcaagagggtaattgcgccaaccacgtcttcaagatgcaccagattgaccccgtgttgaccatccggcgcggtttttccggcaaagaaacgtccgggatggcgcccaggcccgaccaaccccgccagccgcagaatatccactgacgtgcccggcagattatgcagccaatcttccagttccttcagggtacgcccgctggccgtgaccggattacgcggcgtattctctttcaccacgccttgcgcatcgccgtaaacagacgtcgaactggtaaaaataatacgcgggatacgataagccagcgcgctgtcgaccagctcctgcatcgcctgcagataaaaatcctctcccggaccgctacggcgcgcgggcagtgttatcaccagcgcatcgacatccagcagagcgtcaagatcgtccgcctcacagaccaactccggctccagacgcagcggatagctttcaattccactcatacgggccgcttccaccccgtcaagggtggttttgctgccggtaacctgccagcctctcgctgccagcgacattgccagcggcatgcctaaccaacctaaaccgacaattgcgacctttttcatccattttctcctgactttaacgccttatacataaggctacgccagcccgccgtgactgacaattcatactataaatgcgaaatgaaaaaagcgcttgctttaaggcgtaaaagtggtttaggttaaaaggtatcaaatgaataagcattcatcggaatttttatgacacgcgttcaatttaaacaccaccatcatcaccatcatcctgactagtctttcaggcgatgtgtgctggaagacattcagatcttccagtggtgcacgggggctttttttttggcgcgcgatacagaccggttcagacaggataaagaggaacgcagaatgttagacaacacccgcttacgcatagctattcagaaatcaggccgtttaagcgatgattcacgagaattgctggcccgctgcggcataaaaattaatttacacactcagcgcctgattgcgatggcggaaaacatgccgattgatatcctgcgcgtgcgtgatgatgacattccgggtctggtaatggatggcgtggtcgatctcggtattatcggcgaaaacgtgctggaagaagagctactcaaccgccgcgcacagggcgaagatccacgctatttaaccctgcgccgtcttgacttcggcggctgccgtttatcgctggcaacaccggttgacgaagcctgggacggcccggccgcgctggacggtaaacgtatcgctacctcatatccgcacctcctcaaacgctacctcgaccagaaaggcgtctcttttaaatcgtgtctgttaaatggttctgtcgaagtcgcgccgcgcgcggggctggccgacgctatctgcgatttggtctctaccggcgcgacgcttgaagctaacggcctgcgtgaagtcgaagttatctaccgctctaaagcctgtctgattcagcgcgacggtgagatggcacagagcaagcaagagctgatcgataaattgctgacccgtattcagggcgtgattcaggcgcgcgaatcgaaatacatcatgatgcacgcgccaagtgaacgcctggaagaggttatcgccctgctgccaggcgccgaaaggccgacaattctgccgctggcaggcgagcaacagcgcgtggcgatgcacatggtcagcagcgaaacgttgttctgggaaaccatggagaaactgaaagcgcttggcgccagctcgattctggtactgccgatcgagaagatgatggagtgatctgacgcctgatggcgctgcgcttatcaggcctacgtaatgcgttgatattttgggttctgtaggccggataaggcggaaccctgtgatggagtaaagaccatgagcttcaataccctgattgactggaacagctgtagccctgaacagcagcgtgcgctgctgacgcgtccggcgatttccgcctctgacagtattacccggacggtcagcgatattctggataatgtaaaaacgcgcggtgacgatgccctgcgtgaatacagcgctaaatttgataaaacagaagtgacagcgctacgcgtcacccctgaagagatcgccgccgccggcgcgcgtctgagcgacgaattaaaacaggcgatgaccgctgccgtcaaaaatattgaaacgttccattccgcgcagacgctaccgcctgtagatgtggaaacccagccaggcgtgcgttgccagcaggttacgcgtctcgtctcgtctgtcggtctgtatattcccggcggctcggctccgctcttctcaacggtgctgatgctggcgacgccggcgcgcattgcgggatgccagaaggtggttctgtgctcgccgccgcccatcgctgatgaaatcctctatgcggcgcaactgtgtggcgtgcaggaaatctttaacgtcggcggcgcgcaggcgattgccgctctggccttcggcagcgagtccgtaccgaaagtggataaaatttttggccccggcaacgcctttgtaaccgaagccaaacgtcaggtcagccagcgtctcgacggcgcggctatcgatatgccagccgggccgtctgaagtactggtgatcgcagacagcggcgcaacaccggatttcgtcgcttctgacctgctctcccaggctgagcacggcccggattcccaggtgatcctgctgacgcctgatgctgacattgcccgcaaggtggcggaggcggtagaacgtcaactggcggaactgccgcgcgcggacaccgcccggcaggccctgagcgccagtcgtctgattgtgaccaaagatttagcgcagtgcgtcgccatctctaatcagtatgggccggaacacttaatcatccagacgcgcaatgcgcgcgatttggtggatgcgattaccagcgcaggctcggtatttctcggcgactggtcgccggaatccgccggtgattacgcttccggaaccaaccatgttttaccgacctatggctatactgctacctgttccagccttgggttagcggatttccagaaacggatgaccgttcaggaactgtcgaaagcgggcttttccgctctggcatcaaccattgaaacattggcggcggcagaacgtctgaccgcccataaaaatgccgtgaccctgcgcgtaaacgccctcaaggagcaagcatgagcactgaaaacactctcagcgtcgctgacttagcccgtgaaaatgtccgcaacctggtaccgtatcagtctgcccgccgtctgggcggtaacggcgatgtctggctgaacgcgaatgaattcccgacagcggtggagtttcagctcacccaacaaacgcttaaccgctacccggaatgccagccaaaggccgtgattgaaaactacgcgcaatatgctggcgtaaagccggagcaggtgctggtcagccgcggcgcggatgaagggatcgagctggtgatccgcgccttctgtgaaccggggaaagacgccattctctactgtccgcccacttacggtatgtacagcgtcagcgccgaaaccattggcgtagagcgccggacggttcccgcgcttgaaaactggcagctggatctacaggggatttccgacaaccttgacggcacaaaagtggtgttcgtttgtagccccaataatcctaccggacaacttatcaacccgcaggatctgcgcacgctgctggagttgacacgcggtaaagcgatagtcgtcgccgacgaagcttatattgagttttgcccgcaggccacgctgacaggctggctggttgaatatcctcatctggttatcctgcgcacattgtcgaaagcttttgcgctggcgggtctgcgctgcggctttacactggctaatgaagaggtgatcaacctgctgttaaaagtgatcgccccttatccgctttctacgccagtggcggatatcgccgcccaggcgctgtgcccgcagggaataaacgcaatgcgcgatcgcgtggcgcagacagtgcaggaacgtcagtatctggtgaatgccctgcaacagaccgcctgcgtagaacacgtctttgactctgaaaccaactatattctggcgcggtttaccgcctccagcagcgtgtttaaatccttatgggatcagggcattatcttacgcgatcagaataaacaaccttctttaagcggctgcctgcggattacggtcggcacccgccaggaaaaccagcgcgtcattgacgccttacgtgcggagccagtatgagtcagaagtatcttttcatcgaccgggacggaaccttaatttccgaaccgccgagcgattttcaggtagaccgctttgataaactggcctttgagccagaggtgattcccgtattgctgaagctgcaaaaagccggttttaagctggtgatgatcactaaccaggatggacttggcacgcaaagcttcccgcaggcggacttcgacggaccgcacaacctgatgatgcagattttcacctctcagggcgtatgctttgatgaggtgctgatctgccctcacctgcccgcagacgactgcgactgccgcaagcccaaagtgaagctggtggagcgttatcttgcggaacaagcgatggatagcgccaacagctatgtgattggcgatcgtgcgaccgatatccagctcgctgataacatgggcattactggtttacgctatcaccgtgaaacgctgaactggacgatgattggcgaacagctaacgaaacgcgatcgttatgcgcatgtggtccgcaacaccaaagaaacacagattgatgtcagcgtctggctggatcgcgaaggcaacagcaagattaataccggcgtcggcttctttgaccatatgctcgatcaaatcgccacccacggcggctttcgcatggagattaccgttaagggcgatctctatatcgacgatcaccacacggtagaagataccggactggcgctcggtgaggcattaaaactggcactcggcgacaagcgcggtatctgccgttttggctttgtactaccgatggatgaatgtctggcgcgctgcgcgctggatatttccggtcgtccgcatctggaatataaagctgaatttacctaccagcgtgtgggcgatttgagcacagagatgattgaacactttttccgctcactctcttacacgatgggcgtcactctgcatctcaagactaaaggtaagaacgatcaccaccgtgtcgaaagtttgtttaaagcctttggtcggacgctacgccaggctattcgcgtggagggcgatacattaccgtcctcgaaaggagtgctgtgatgaacgtcgtcatccttgacaccggctgcgccaatttaagctcggtaaaatccgccgtggcgcgccacggttacaccccggtggtcagccgcgaagcggaaatcgtattacgcgctgacaaactctttctgcccggcgtcggcacggcgcaggccgctatggatcaactgcgcgaacgtgaactgatcgacttaattaaagcgtgtactcagccggtactgggtatctgctgggtcgtcgcagcgaagagacgcgcggcgtggatctgctgaacattatcgaacaagacgtgccgaaaatgaccgactttggtctgccgctgccgcacatgggctggaatcgcgtgtatccgcaggcgggcaaccggctgtttcagggcattgaagatggcgcctatttttactttgttcacagctacgcgatgccggtcaacccgtggactatcgcccagtgcaattacggcgagccgtttaccgcggcggtacagaaagataatttcttcggcgtacagttccacccggaacgttcgggcgcggcgggcgcacagttgctgaaaaacttcctggagatgtaatgattattccggcattagatttaattgacggcaccgtggtgcgtctccaccagggtgactacgcccggcagcgggattacggtaacgatcccctgccccgtttgcaggattacgccgcccagggcgccggggtgctgcatctggtagatctgaccggcgctaaagatccggctaagcgacagataccgctgattaaaaccctggtcgcgggcgtgaacgtgcctgttcaggtcggcggcggcgtgcgtaccgaagaagacgttgcggcattactgaaagctggcgttgcccgtgtggtcatcggttcaacggcggtgaaatcccctgacgtggtgaaaggctggtttgaacgttttggcgcgcaggcgctggtactggcgctagacgttcgcatagacgaacacggcaccaagcaggtggcggttagcggctggcaggaaaattccggtgtctcgctggaacaactggtggagacctatctccccgtcggcctgaaacatgtactgtgtaccgatatttctcgcgacggcacgctggcgggctctaacgtttcgctgtacgaagaggtatgcgccagatatccgcagatcgcctttcaatcctccggcggtattggcgatatcgatgatattgccgccctgcgcggcaccggcgtgcgcggcgtgattgtcggacgcgcgctgttggaagggaaatttaccgttaaggaggccatccaatgctggcaaaacgtataattccgtgtctggatgttcgtgatggtcaggtggtgaaaggcgtacagtttcgcaaccatgagatcattggcgatatcgttccgctggccaaacgctatgccgacgaaggcgcggacgaactggtgttctatgacattaccgcctccagcgatggtcgcgtagtcgataaaagctgggtggcgcgcgttgccgaggtgatcgacattccgttttgtgtagcgggcggcatccggtcaattgacgacgccgccaaaattctttctttcggggcggataagatctctatcaactccccggcgctggctgacccaacgctgattacccgtctggctgaccgttttggcgtacagtgtattgtcgtcgggattgatacctggtttgacgacgccacggggaaataccatgttaaccagtataccggcgatgaaaaccgtacccgcgtgacgcagtgggagacgctggactgggtgcaagaggtacaacagcgcggcgcgggggaaatcgtcctgaatatgatgaaccaggacggcgtgcgtaacggttacgatctgacgcagttgaaaaaagtccgtgacgtttgccgcgtgccgctgatcgcctccggcggcgcgggcacgatggaacactttcttgaggcattccgtgatgccgatgtcgacggcgcgcttgccgcctccgtttttcacaagcaaatcatcaatattggcgaattaaaagcgtacctggcaggccagggcgtggagatcaggatatgttaacagagcaacaacgccgcgagctggactgggaaaaaaccgatggcctgatgccagccatcgtgcaacatgcggtatccggcgaagtattgatgctgggctatatgaacccacaagcgctggacaaaaccattgaatccggccatgtcacgttcttctcacgcacgaaacagcgtttatggaccaaaggcgaaacctcaggccatgtgctgaatgtcgtcagcattgcgccagattgcgacaacgatacactgctggtgctggcaaaccctgtcgggccgacctgccacaaaggtaccagcagctgctttggcgacgccagccatcagtggttattcctgtatcaactggagcagctactggcagagcgcaaaaccgccgatccgaccagctcttacacggcgaaactgtacgccagcggtaccaaacgtattgcgcaaaaagttggcgaagaaggtgtggaaaccgcgctggcggccaccgtcaatgatcgttttgaattaaccaatgaagcgtctgatttgatgtaccacctgctggtgctgttgcaggatcaggatctcaacctcaccaccgtgatcgacaatcttcgtaagcgtcatcaataagcgtaaaaaaaccgggcaatgcccggttttttaatgagaaattttacctgtcgtagccgaccaccatccggcaaagaagcttacaaggcttttggcttatagctacgtagcgcattgcgtcccagcacaatcccggcaccgatcatcccacccagcaatacagccagcacaagggtaatggctgttttcgggctatcgcgacggaccggcagcgtcggcttcatcacataacgatagacgtgcaccgtatcggcagtcactttcagatttttaatgtccagcagtgtctgcttcgtctggtaataggccggagaaaagaccagtggacgcgtcgcttcgttctgtatcatcgattttagcgcatcgctccccaacaggaacatcgtgtcctgggtaacatcctgggtttgctgaatctgcggctgcgtgattttggcctcatccgcatagcgcaacgcttcttcgatttgcttaatacgcagatctttttgctcctgcgccacaacttcctgcgtctcaagggactcctgcaacgttttggtttgcagcgtgatgttatctttcaggtcaacttccagttccttagcgacctcttcatccacctgttggatatattccgccagccgacgctgcgccccttcagcggtagtactcacataagaaaccgagagtggcagcgcctgcccttttaccgactgttcaatggtaagcttttcccgctctttctgattatccagcacttccgataatgcggaaaacgcagagctaaagcggcttataaaattcgcctgcacttcagagattttgggggcattcccaccatacaagacgttgagcgcgttggtataggtggcaacctgcgcggcatcaggttgggtaataatcgccgtggatgtccatttttctttggctatcatcaggtagcctacagccagcaaaatggcgataataacggctacaataatggtcatcttcccacgccataactgtagcaataactcaatcaaatcaatctgttccggatcgttcccacgcccggaagacgtattactatccactgtcatagataccctaactaaaaaaaggatgaagctggagacagtgtagccataaagcaaatatatgccataggattaatgataaaaatcagacattatttccatttggtcaataaatcatcgggactcatcagccccgattgccttattaatcactaccgaaaagatcgcgggtatacactttttcagcgacatccaaaagctctgccgccatcctgttggaaataatgacatccgcctgctgtttaaagcagtgcaaatcacgttcaagacgtgagttaaagaaagtatcttcttccattaccggctcatagatgatgacctctacgcctttcgctttaatgcgcttcataatcccctgaatcgatgaggcgcggaagttatcggagccactcttcataatcaggcgataaatgcccaccactttaggctttctggcgaggatagcgtcggcaataaaatctttacgcgtacggtttgcttcaacgatagcggagataatattattaggcaccgactgataattggccagcaactgtttggtatcttttggcaaacaatatccgccataaccaaaagagggattattataatgattgccaatacgcgggtcgaggcacaccccttcaataatttgtcgggtatttaatcctaacgtttcagcatagctgtctaattcattaaaataagcgactcgcatagcgagataagtattggcgaaaagtttaatggcttccgcctcagtggagtccgtaaacagcgttggaatctcctgtttaatagcgccttcctggagtaatgcggcaaattctctggcgcgctcagactgttccccaatcacgatacgggagggataaaggttatcgtaaagggctttaccttcacgtaaaaactccggagagaaaatgatattttctgtcgcaaacttctgacgcattgccgccgtgaagccaaccggcaccgtagacttaataatcatcactgctgcggggttgatgctgatcacatcctgcatgaccgattccacactggacgtattaaaatagttagttttgggatcgtaatccgtaggcgtagcaatgatgacgtaatctgcattctggtacgcatcaaacttatccagcgttgccctgaatctgatgttatcttcctttaaaaattgctgaatttctttatcaacaatcggagatatccgatcatttaacagttcaacacgggaaggaacaatgtctaacgccaccacatcatgatgttgtgcaataagcaaaccattagacaagccaacataacccgtcccggatatcgtgattttcattattcgctctcagaattaacttaattatgaatcatgatgtatttcgcatcctgataagatattaaagttttaacgcctgagtatataaagtgcaacgcagacgaaaacaattcagattatcttcattacgataaacacagattattaagttaatattaagcaaaagcgataaatcaataagaatagagataaaaaaaagcccggtattaaaccgggcttaaacatttttgcagaaattattccaaccattcggtatggaaaatgccttctttatcagtacgtttataggtgtgcgcaccaaagtagtcacgctgcgcctgaattaagttagctggcagtactgcggcgcgatagctgtcatagtaggccactgccgcagagaatgtcggcaccggaatgccgttctgcaccgcgtaagccacgacatcgcgcagcgcctgctggtactcatcagcaattttcttgaagtaaggcgctaacagcaagttagcgatatcggcgttttctgcgtaagcatcggtgatcttctgcaggaactgagcgcgaatgatacagcccgcccggaaaatcttagcaatctcgccgtagttgagatcccagtgatattcatcagacgcggcgcgtagctgcgagaagccctgcgcataggagacgatcttgccaagatacagcgcgcgacgcactttctcgataaattcagctttgtcgcctgccggctgcgctttcggcccggagagcactttagatgcggcaacacgttgcgctttcaacgaagagatgtaacgcgcaaagacggattcggtaatcagcgacagcggttcacccagatccagcgcgctctggctggtccatttaccggtccctttgttggcggcttcatcaagaatgacatccaccaggtagtttccgtcttcatcttttttagtgaagatgtctttagtgatgtcgatcagatagctgctcagctcgccgttattccactcagtaaaagtgttcgccaactcttcattgctgagattcaggccgcctttcagcagggagtaagcttcagcgataagctgcatatcgccatattcaataccattgtggaccatcttgacgtagtgaccagcaccatcggcgccgatataggtcacgcacggttcgccatcttctgccacagcagcaatcttcgtcaggatcggcgccaccagttcataggcatctttctgaccgccaggcatgatagatggccctttcagcgcgccctcttcaccaccggaaacaccggtaccgataaagttaaaaccttccgcagacagctcgcgattgcgacggattgtgtcctggaagaaggtgttaccgccatcaataatgatatcgcctttttccagatacggtttcagcgaatcgatagctgcatcagtacctgcgcccgctttcaccattaacaggatacgacgaggcgtttcgagggattcaacaaactctttcaccgtgtaataaggcaccagctttttgccgggattctcggcaatcacttcttcggtcttttcacgggagcggttgaaaacggagacggtataaccacggctttcgatgttgagcgcgaggttgcgccccatcactgccataccgacgacgccgatctgttgcttggacattacatactcctgtcaggtgtggaaaccctgccacaaacggtcatggcaggttaaaggtgaatagtatgttaactcaaaggtatgatattaaggtagcgattgatgcgttcagattttacgcaggctaatttatacaattattattcagtacttctcggtaagcttaatacgcaccatctcgccgcaaaacaactttcgctgttttaaacagaatggcaatatcattccaaagcgtccagtttttaacataccaggaatcaaaataaacacgagtgtcataatcaacatcattacgcccactcacttgccatagacctgtcatgcccggctttgccatcaaataataatcaacatcatcacaataacgctccagttcatccgaaacgataggtcgtggtccaaccaggctcatatcaccttttagtacattaaaaagttgtggcaactcatcaaggctagttttacgtataaatcgacctacagctgtgattcgaggatcatttttcagtttaaaatctttctcccattcagccctggcaataggatcgttagccaaaagttcttttagtacctcttgagaattcataaccatagaacgaaatttgtagcatggaaaaagttttccatgccgacctactcgctggtgaccataaatagccggaccaccatctcgagtaactttataccacagataaatcataagtggtgatgcaattataagaatcattattgaacaaacaatatcaaatgtccgtttgagaaaacgggacgaccttttagccaagttattttgtatccttaataacataacttcatggctaaagataaaagacatatcagtattatataatggcaatcctctaaacgaggggactacagtaacagaacgacaatgatgttttgaaagttcacgtagccaaaaatgtgttttctccaactcggtgtattcataagcaaggatataatggacatcacctgtacgatttaaatcccaaataatctcagtatcctttatcaccggcaacatatttatttcagcatctgacgcatccgtatcaaaaaaagcgataacatcaaaccccatcatctcctcactttgcagcgcagaatatgcaccacgagcattctgtccgctccccaggatgatagtttttttcttccagatacctagcttgttcaataaatgctttgtaagtgcgcgaaaaaaaggcaccaggattagggcaaaagtccaacaaaacacccagacatagcgtgaaaactgccattttgtaaacgctatcagagccaaatcaaatatagcaaaaataacgatcgtacgaaaaatttcttttaactcataccaaaatggcttgcggtatgtataatgtcgcaaacgaatccaaaaccaaccgacacatactactgacaaaataaaatgcgtaataactcttgtatctaattggtcttgaggaataaatcgctgtacttgatcaaaaataaaatagacacatcctaatgaaaaccataaggctaaattaaaaaaaatcaaatccgatatagccaaaaaaattttacatagctgtggattatacttattatcaatattatccatttaatcctcaccctctgaccgtgcataatgtaaataaaataggcatattaagtaaataacattcaatttttttacagcaagcatcgttttttaatattagcaagcgttgtatttacaagatcctgagccctatttaataaattagcttctgcatagcagcgtaactcaggtgcattaccagaagcgcgcaaatgcacaatacatccatcacgtaaagtaattcgcataccatctgtcatatctgtagaaattgcaccttcattctccaaaccaatatagcttaagaggttgctcagattttctctgcccatactaattaaggattgacttttatcagttgtaatcccctgtaatctgtcagaatgggtgtaacgagttgggagttcattgactaaagcgctaatgctggtattcctacttttgtaaagcagcattattgctggtaatacagcatcacgagttggtaaggcatgaagattctgctcgttaatacagatgtcgcttcctaataaaaaaccgccattggcttcaaaaccgacaatacgactataactccgcgataattcattaaaagcttcgataacataaggcgagccaatttttgtaagcttaacatgtttaaaaaagcggccagaagaaattatgctgttacaactaacaggaatagcgacggcttctgcatccaatgcaagtgaacataatagacctagtatatcgcctcttagccactcaccggcctcatcagcaataagagggcgatcaccatccccatctgtcgagaatatggcatctaaatcgaactctttagcccatgagcgagctttttcccgatcctctttgcttacagcctctgtatctataggtacaaaattatcgcttctacccaagctaacgacttcagcccccaatgcaataaataaaggcttataaagatcacgcccagcgcttgaatgttcgtaaataccaatacgcttatttttcaggaatggagtagaaaataaagatgtataacgagatatataattaacagcagccatttctgaaactatgagttctttaagctctaaatggctgcacgtatcttcaacactaaggatcgcagcctcatcatgtttcgtgatttcaccatcaggacgataaaacttgaggccgttccgctcgaatggaatatgacttcccgtaaccattatcgcaggcatattgtcagacatagactgaaaggccaaagctggggttggtaccactccataaaaaatacagttaacgcctttatccgccaatgcagcagcacacgcctgagccatcccataactacttggacgattatctattgccaatgctacggtatcaaaggaaaaatgttcctgcataacggcaacaaatgaaaccgtaaaagcagcacatacctgaggtgtaaaatcttttacaagaccgcgagccccactcgttccaaacacaatacctgatgaataaataacatcacggctattattaactacgttcattagtccactccttcgaaaatccagaacgttgttctaaacgaataatatcatcctcaccaagataggtacctgattgaatctcaattaacttcaggggggtcattccaggattttccagcgcgtgaatagtattcggaggaataaatgttgattcattttcagaaaccatataagtctgctctccctttgtaacacgagcagtcccggataatactatccaatgctcagcccggtggtgatgcatctgcgccacaaatttctcacccggcttaacagtgatacatcgaacgaggtaatttttgccgctatcaatcacattatattttccccaggggcggaaaacttcttgatgttgtttatattcgttcctatcattccgttttaaataatcgacaatttttttaacatcttgtactgtatctttattagccaccagtaaagcgtctgttgtttgaacaatgacaagattgcttacaccaatcgcacttataaacatatcttcggaataaatgtaattatcattacaagcatgtgcgaaaatatctccttttaaaacatttctctgatgatctttattcgatatatcccaaagtgaggaccaggaacccacatccgaccagccagcgctcattggtatcaccaccgcatgctgtgtgtgctccataactgcataatcgatagaatcactcgggcatgacataaactcttctttatcaatacgaataaaatcaagatcgggatttatatgtcctaccgccttttcacaagctttataaatttcaggtgataaatactttaattcgtttaaataagagcttgcacgaaataaaaacataccgctattccagtaatatttccctgatttgaaatagtcaccggcggtatcgatatccggtttctccacaaattcagccactgcataagcgtcatttcctatcaactcaccacgacgaatatatccataacccgtttcagcatgcgttggaacaataccaaaagttacaagcttaccatttgcagcgtattcttcagcatgtctgacagctttcgtaaaagctatttcatcctgaatcacatgatctgcagcaagaaccaacaaaagaggatcagcattatcagcattctggagcgcacaaaacgcggcaagagcgatcgctggtgcagtattacggcctaccggttcgagaataatattatttgctaacttgtcaatttcacggagttgttcagcgactaagaaacggtgtctgtcattgcaaatgacaacgggttcttctgtagaaagtgaagctaatcgctttatagtattttgcagcattgatagtttaccttcaacgcttagaaactgcttcggatgatattcgcgtgaaagcggccataaacggctacctgtgccgccagccataattacgggaagaaaagacatttattttatctcttttgacgaagaatattggatattattccaataactcttgtacatgctaaaatagcgacatgtagacaacggtaaagattgccaatgcttgcctaatttgtaacccaagaatttagcaaaggttgttaataaagctcttggaatccagaacggtgcatttttaagcaggaattgaatctctgattttacgaagcggaaaccctcaccaccggctccgccaaagtcacgctgaatccacggagaacaagcatgaaatacaccagtatcaaaatatcgttgaaactcttctcgcggggtataattatgggagtgtcttaccaccgcttcagcgcagtaggcgaccttataacccgcctgaatcatcttagccgccataaacatatcctcggcaagaattgtatgttcaggaaacccacttaactcttcaaaaacggaacggcgataggcagcaaaagaattggacataaatacagttttaatacccaatttttctatatctgccttacttttaacaatagattttgaactataattaaaatttctggcatgcactgcaaggggattagcatctttatgaggaagttgtctaccacaaaccgctgctatcaatggatctgaaaaataataaaccaaatttttaattgcatccgaatccgcgagaattgcatcttgcgttagaaaaattataacatcagcgtccagagtttttgcaactgctaaatttctggttcctccatgattaaaatctttagagtcaatattaaatattgatatatttttcaggtctgaggctaacggaaccgtttcatctttagaacctgagtctataacaatcaatttatccggatatatagtttgctgcttaatcgcatccagaacattaggccaaagcgaccctgcattatatgtgggaataattaatgttattttcatttattttgattccgccaaccaattgccaaccatctgcttcatattatcaaagtcataccgtgcgacatagttgttaaatcgggaaattgcatcaggcaactgctctatatttttaattgcactctgccagcttttttcatcatccggattcacatataatgcaccattggttaacacttcatgaaatactggtatatcggacactataactggagtatttgatgccatcgcttcaataggaggtataccaaaaccctcatcaatagatggataaacaagcgcgtaggctttagaatataaaatctttaattcattaaatgagacttcatgtaaaaaagtcactttatcttttagttccagatcaacgaccatttgttggagagacattgcatagtcagtacgaccacatacaataattaaattataagagtcagaccaaacttttttattttttatgaatgaatgaatatttttatgtggccaacttgcaccaacagctaaaaagtaattctctttttcttttttttgtataaaatcagatttattaacactattataaattactgatattttctcactatctacattataagttttagcaatgctatctttaacggtataagataccgttaaaacatgcttacatcgcttaacggacatttttaataaaaagcgaaaatacactttctgaataaaactatctggataataaaaaggtcttatatcatgtacggttatcgtttggtttctcagtaaggggatagtgtgatgtgtagtacacaccaattttttattaccaaacttaattaaaaccctcagcgcaagccagtaactatatacataccatactaatggtctaagtcgcgatgtttttgatgtgttgctaacaatattcggaacagtaactactgcataaccgagcttttcaaaataatcagcgtgtaccttgctacagattattgcgtcaacatcagctatttctcgcagtgccgttaaaaatttaatcgagtattgccacattcccgtaccacttttacctaaacgtgataggtttacgatcattgaatagctctccgtttttccatacgcatctttaaagcaataatcataaggataaataatattacgaagcttacactaggtgtaattcttaataatagagttaatgtaataccggcagtaaaacactacaaaaacaatcataaagaaatatattattatactaacattcccagaaaaaaacatctaagtagttaagctatccaaatttatttatatatatcaaatatgatttttcattaaaaagaaaagtcagtaacgtaaatctagctgaatccagaaaggttaaatctacatttaatctcaatataataacttactactacttaattatccgtttagtaaaattcttaagcacggtaatatttttcactgcatatgctagtttcccaaatcgaagtacagtgttgatcatatttttattacaacctagctttgcataaaattcagataaatctcttttttcatcactattgccataacatgccatagccaaagttgtatataaccatggtctctcttttagcaaaacattttcaaatgctcgttttaaagatatatttttactgtaaaaatcattagctaattttaaatatgcaataaaatcaattaaaattcgtctggcctttcctttcttctcgaaactatcattatctcctcggcatattacgagtggttttgatatataatgcaaaaggcaccctggcgtattaaatacgctcatcatgataaatacatgaggataggaagtgccaatataggacgcatcaaaatcaatggcatcccatcgttctttttttactattaaagaacttagatagctaaatacaccaccaatagataagcatctactgagatagatttccctatctaaattattattaaacacataaagttcatcatctgttctgagccaagaacgatgagggtttctaatctcaactaaatcacacccggtctcttttctgtcacataaatatatatctgcttgagaatcgagataagtttgtaatatcgctaacgagtctttcgcaagagcatcatcactgccaaatatccaacaataatccccattcgcaagggatactgaagcaagaaaattcctatctggcccaaggttaacgctattacgccgatatattattgggaaattataattgttcctccaaacatcaatcatttcctctgtaccatcagtagaggcattatctgatatacatatctcaatatctaaattaaatttttcctgattatttatactattcaacaactcttcaagatattcttttctattataagttggaatacaaaatgatataagcatatgattatcccttatttgccttaattaagtaagttagtggaagcccccaaaaaacagttaaagcaaaagatataatcaagccaagcagcactccactgattccaagcgtactagaaaaataccattgtgctattccaccaattattgcttgtagtggtactaatatccaaagtatttttaaataattcatactttgcaataacattgcataagtgtcacaccaaacgcgaatacagaaatatatgccaattaacataaaagataaaatagaaacttgataattaatatctttggctattactgaaaatatctgttctttaaataaataaataaatattgtacatccaacaacatatagtgagccaagcaaaatattgacacctatcattttgttaagttttttccattgctgtttgactctcaattcagcacatataggccataatgcttgcaaaatagcagtataaataaaaaagactaaaccaaaaattttcatcgttactgtatattgaacaatatcagcaggagttagcctttgagaaatgaccatataatctgtttgaagcaccactatcgataataaagtaaaaagaaaaaaccctgaagatctacgtaaaattgctatataatgagattttgttgttttaacatgataaagctttatgtatctatatacaatatagcacaatgaaatcatacccactggaagatacaggactattagtgataattttatgtcaactgagatccccctatagtatatatatagcaagccgagcatacctatcatataagataatgcgtttaatagattagctttccacccgaccaattcggcaaaaagtattttataagcaatagctccgattccaatagaactgaaaaccagacatgaggtaaaaaagagcattctggttttgtcctgtaatacctcatgaaaagaagaaagatatttagcggaaattaccccagaaaaaatataaaataaagcaataaaaaaaataatagctataaagcttagatgtaatgctgatttaatatatgcatcataacttttgtttttggctctgcattctgatatataattttgcagtcctgtacctatgccaaaatcaacagcgctacaccatactaataaaccagttaacaaactaaagattgcatatttctcttcacctagcatagaaataagatatgaaatacttgctaactgcaccccggcaattattattttggataaccatgatgaacctgcaacaattaaatgactcggaatttttaacaattgaactttcactatgcaattaaacgacttagtttttacaacataacgcgactaatttgttaacgatttatttattaaaagatcatgaaaatctcataaccgtttcagtagttcttcaattccttttttataatcgaaatttggtttccagcccattgcttttaaatttttattatttgctacagagaacattatttcattatctctttgctctatcgcaccaaattcaaatatactcgatgaacctggcatcatagtattttgcaaataaaccagaaaatctttcaaacttaccccagcaccagttccaacttgatactcagtatatgaaggtacttcttttctattttctaatatagttaaataagcatttaccacatcatctacaaaaataaagtctcttatctgttcgcctgttgtacatttcacgcaactctgttttttatttaagcagtcgataatgtatggaataaatttattttcaccatccccaggcccatatacatgctctaatcgcatgtttacaaatgaaatgtcatgcatattagcataataatgcccaatttcatcaaagtgtcttttagtaattatataaggccgcatatgttgataattaaaatctttcttggcaaaaaaactatctgtatttaaaaagatatccgcccgatattttattgccaaatcaagaagctttaatggttttataacatttgcatcttcaatatttatgagagatgatgttttatgcccatattctgttgccaaatgaatgataccaattaatgcagaatcaattgataactcctcgactaataattcgatattatcccaactgcaccatctaacattagctaatgcattactattattttttattacatctcgagtgattgcgacaactgaaatccccgatttttttagcgcttcgagtaaatgcttaccaataaagccggaagccccactgacaattacatattctttcaaaaaggtcatcgcaatcaccagatagaataaattgaattagaaattcaaaccaaagaactcttcaaacttgctaactacataatctaaatgctctgtagtcaagcctggataaataccaatccagaacgtttgattcattatacggtcggtatttgtcaactcacccactacacgatatttcacattagcaaaatacggttggcgaatcagatttccagcaaacagtaaacgtgtaccgatttttgcttcatcaaggaatttcaccagttcgacacggttaacaccgctagtttctttcagggtgatagggaagccaaaccaggatggatctgatttctctgttgcttctggtaattcgaggaattcagtgcaagattgcaagccctgtttcagataggaaaagttagctttacgctgctctacaaactcttctacgcgctccaactgagccagaccacatgctgcctgcatgtccgtgattttgagattatatccgaggtgggaataagtatatttgtgatcatagccttgaggaagtgatcccaattgctgaccaaaacgtttaccgcaggtgttatcgcatcctggcgcacaataacaatcccggccccagtcacggaacgactcaataattttcttcagttcacctgacttggtgaatacagcaccgccttcacccattgtgatatggtgagccggataaaaactaacggttccgatgtcaccaaaggtacctaccatctggccttcataagtcgtcccaagggcatcacagcagtcttcaatcaaccataagttatatttatcggcaatccgacgaacttcactcaggttaaatgcattaccgagtgtatgagcgatcattatcgcttttgatttctcagtaactgcagcttcaatgagagaggcatcgatattatatgtcgggatatcaacatccacgaataccggtattaaaccattctggatcgccgggttaactgtagtcgggaagccagcagcgacagtaataacctcatcaccaggtttgagagctcgctcgcctaattttggggaagtcagcgcagtcagtgccagcaagtttgccgaagagccagatgttgtcgttaaaacatgaggaaccccaataaattccccaagttttttttcaaaggcatcattgaaacgaccagtagttagccatccatcaagagacgcctcaaccatcaattgtaactctttggcaccaataaccttcccggaaggaggcacaacgcttgtacctgcaacaaaaggtttcgggctcaatgcctcattcgcatactgagcgacaagctgagagatttgctcacgcaggttatttgctgtcattactttgattccttaaacttattttcttaacgagtagttgcagacatatagtcgctgatttcacgctttgaacaaatcaacatatcttcgccgcgaatccatgctttatgccattttacgatgcgaccaagtgtttcagtcaatccccaacgcggatgccatcctaattgcatatttgctttagagcaatccagtttcaggtaatgtgcctcatgaggatgattctcaccatccagtaaccagcttgcatcatcaccccaaagcgtgaccatcttgtcaacaataaattcgaccgtcttcgcatcttcatcacgcgggccgaaattccatccttcagaaaacttagcaccttctgtatataagcgttgcgccaccacaatgtaaccagaaagaggctccagtacatgctgccagggacggatagaatatgggtttcgaataataacctgctggttattttcaaatgagcgcagaatatcgggaattaaacggtctttagcccaatcgcctccgcctatgacattaccagccctcacagacgccaaaccaacgccatgttgctcataatttgcaggattgaagaatgagttccggaatgcagacgcgactaattctgcacaacctttactattagagtatggatcgtaccctcccatgggttcgttctcacgatagccccacacccactcacgattgtcgtagcacttatcactggtgatatttacgactgcctttatgttacctacttgcttaactgtttcaagcaaatggacagtacccataacatttgttgagtatgtttcgattggctgttcataagataggcgcactaaaggctgggctgccatatggaaaacaatttctggcttaaattctgcaatagaattgcgcagcttttcaaaatcacgaatgtcgccaatatgagattccataagatcattaagacgcactatctcaaataaacttggaacagttggcgcatcaagtgcatagccttttacaattgcacccatttcagtcagccatagcgaaagccagcttcctttaaagccagtatggccggtaacgaatacacgtttaccttgccaaaaatttttatcaatcatctagttactcccaggttttccacggagctttacctttttcccacagcccttcgaggtaaactttatcacgtagggtatccatcggctgccagaaacctgggtgttcaaaagccattaactccccctgttgtgccaatgtcattaatggctcttgttcccaggttgttgcatcgttatcgatgagatcgataaccgatggattcaacacaaagaaaccaccattgatcattgccccatcgcctttcggtttttcctggaatgaccggacctgaccagctcggatatctaatgcgccaaagcgtcctggtggaaaagtagctgttaaagtcgctttcttaccgtgagccttatggaaatcgatagtcgctttgatatcaaggtcggcaacgccatcaccataagtaaacaggaaagcctcgtcatcttttacgtattcagcaacacgtttcagacgaccaccagtcattgaagaatcacccgtatcaaccaatgtgacattccatggttcaacacgtttatggtgaacttccatacggttttcagccatatggaatgttacatctgacatgtgaaggaagtagttcgcaaaatattctttaatcacatatcctttataaccacagcagataataaaatccttgataccatgcacagaatacattttcataatgtgccaaagaataggcttgccaccaatttctaccatcggttttggttttacaattgtttcttcacttagtctggtaccaagtccaccagccaggatgaccgctttcataaattatcctcaatattattagatgcggtaaatgcatcagaatagaaatgttctacagagagatttttcatcataaagtcctttttactggcatcgatcatcacaggtgaaccacatgcatatatatcgaagaactctagagaatcaaaatcatccatcacggcatgatggacaaatccctttcttcccccccattcggcgtcatcaccagaaacaacagggatataatgaacgttgtcgtgctgttcactccactgctgcggtaatgcagagtaaaaatctttactatattgcattccccagtaaatgtagatctcacgacgacattttccctgaatgagatgctcaaccattgatttaactggagcgaatccagtaccgcctgcaaggaagattataggtctgtcactttcacgaataaaaaatgttccgcaaggcccttcaatgcgcataagagtattttcttgtaactccccaaaaatgagcgaactcatctgaccattgggaacattccttacatgcaactcaataccattcgactcatcactattagcgatagaataactgcgagttacacctttataatgtaaattgatatactgccctggaaggaagccaatttttgctgttggtggtgtgcgtaacttcaaagtcataacatcgcctgaaaccagtacagcactatttaccttgcatgggacaattttttttgtctgtccagctagttcaggaaaaaaatgcgcatttagctcaagggcggttttaggtttacagcagcaggttagtattttatcaccctgtccaaaaatattacctttggagtcaacaacttctcccgccaacaaatcggactcacagataccacaatcacccgctttgcagctatgttcaagatggataccagccgatagcgcagcatcgaggattgattcatcctctctaccggaaaattcaatatttgatggaaaaatcttaataatatgagacacgatgcttactctgttaacaaggcttgatccagtaaaggtgctgcagcatcttttgctgaaagctcaggcagctgagaaaaaggccattcaatacctattgcctcatcattccatagaatgctaccttccgatgaaggtgagtaataattagttgctttgtacagaaactctgcatactcactaagagtaacaaaaccatgagcaaaaccttctggaatccaaagctgtcgcttattctcagcagacagatttacaccaacccattgaccaaaagtaggcgattcttttcggatatcgaccgcaacatcaaaaacctcaccgacagcacaacgaactaacttcccctgtgcattttctcctctctgaaaatgtagccctctgagtacgttctttttggattttgaatgattatcttgaacaaatgtaactttacgtccaatcaactcttcaaaggtctgctggttataactttcaaaaaagaatcccctctcatcgccaaaaactttaggctctaagatcaagacatctggtattgctgttttaatcacaatcatcacttataaacctttcaccatcttcagcaaatatttgccataatcattttttgataatggcccggccagttctataacctgttgtgcatttataaaatttttacgaaatgcgatctcttccgggcaggacacttttagcccctggcgttcttcgatggttgcaataaaattactggcctctatcaaactctgatgcgtccctgtatccagccaggcataaccgcgccccatcatagcgacagacaatcttccctgctccatatagatacggttaatatccgtgatttctaactcaccgcgagcggaaggcttaagatttttcgccatctccaccacgctattatcataaaaatacagccccgttaccgcgtaattactcttcggttgtaatggtttttcttccagactaacggctgtgcccttttggtcaaactcaaccacaccgtagcgctccggatcgtttacatgataagcgaagacggtagcaccactttctttattaacggcagcttccattaactttggtaaatcatgaccatagaagatattgtcacccagcactaatgcacaatcatcatgaccaatgaactcttcaccaataataaacgcctgtgctaagccatccgggcttggctgtactttatattgaagattcagcccccactggctgccgtctcccagcagttgttgaaaacgcggcgtgtcctgtggcgtactgatgatcaggatatcccgaatgcctgccagcataagcgtggaaaggggatagtaaatcatcggtttatcataaattggtagcaattgcttacttaccgccatggtcaccggataaagacgggtgccggagccccccgctaaaataatgcccttacgcgttttcatttccatttctcattcatagaaaatgccctgatgggcatttaaatttattagatggttgtcgtcgtaaacatttcagtcagcatacgcttaactcctaattcccattgaggcagaataaggtcaaaattacgctgaaacttttcagtattgagacgcgaattgcctggtctgctcgccggcgtcgggtaggcgctggtcggcacagcattaagctcagtcagcgcaagcgttatccctgctttgcgcgcctcgtcaaagactaaggccgcgtagtcatgccaggttgtggttcccccggcaaccagatggtaaagacctgcgacttctggtttatttaacgccacacggatcgcatgcgccgtacagtcagccagtaattccgcaccggttggcgcaccgtactgatcgttaatgactgaaagtgtctgacgctctttcgccagacgaagcattgtctttgcgaaattattgcccttacctgcataaacccaactggtgcggaagataaggtgtttagggcagttatcctgcagggccttttctcccgccagtttggttttgccatagacattcagcggcgacgtagcgtccgtttcctgccatgggatatcgccggtaccaggaaatacataatcggttgaataatgcactacccatgcgccagtttcgttggctgctttagcgatggcttccacactggtggcgttaagtaactgcgccagttctggttcagactctgctttatctactgcagtatgggctgctgcgttaacaatcacatcgggacgaagcttacgaacggtttcggcaacgcctttcggattactaaaatcaccgcaaaactcttttgaatggacatccagggcaatcagattccctaccggtgccagagaacgttgcaactcccagcctacttgccctgtcttaccaaaaagtaagatattcattactggcgtccttcatagttctgttctatccaactctgatacgccccacttttaacattgtttacccattgagtatttgcaaggtaccattccactgttttacgaataccgctttcaaaggtctccagcggtttccagcctaattcgcggctaattttacctgcatcaatggcataacgacgatcatggcccggacgatccgcgacataagtgatttgttcacgataagaagtcgctttgggtacaatctcatccagcagatcacagatggtaaataccacatcgagatttttcttctcattgtgtccaccaatgttataagtctcccctgccttgccttcagtcactaccatatgaagcgcgcgagcatgatcttctacatatagccaatcgcgaatctgatcccctttgccataaattggcaaaggctttccttccagtgcgttcaaaatgaccaacggaatcagtttttcagggaagtgataagggccatagttattagaacaattggtaacgatcgttggtagaccataggtacgccgccaggcacggactaaatgatcgctggatgcttttgacgcagaataggggctacttggcgcatatgccgtcgtttcagtaaataacggcagcgtaacgctgttttcaacttcatcaggatgcggtaaatcgccgtaaacttcatcagtggaaatatgatgaaaacgaaaattattttttttatcttcgccaagggcagaccagtatttacgcgcaacttcaagaagtgcataggtgccgacgatattggtttcaataaatgctgctggcccggtaatcgaacggtccacatgactttccgcagccaaatgcatcaccgcgtccggctggtactgctcaaaaatacgcgttatttcagcggaatcacaaatatccgcgtgttcaaaattgtagcgattactttcagaaatatcagaaagggattcaagattaccggcgtaggttaatttatcaatattaactacagtgtcctgtgtattcttaataatatggcggacaacagctgatccaataaaacctgccccgccagtaataagtatcttcacttttctattccataaggcgtatttaatgtggtatttaatttgccaataaaaattaattgctcaagtcgttacacacgctaccgcccctggctcatcagctaccagtgcactgcgtacatatcgacttgttgcaaacctcgcccagcagggcaaagctcactaaaacttaaacgctaattgtcttattaattgcatccggaaacaaggattaatcttataaaatcagcattaaaatgctccagataaccccttgttacttaagccctttatacaaaactaaaacggcagtcaacactcgtttcagccaacttgccgcttcgaatgttcactgccgttattatgtttatcaccaaccatttatcacggttgttaatacttattcatgcaaaagctgctctatgctcttacggaacttggctccttctttcaggttgcgcagcccgtacttcacaaatgcctgcatgtagcccatttttttaccgcagtcatagctgtcacccgtcattagcatcgcgtcaaccgactgttttttcgccagttcagcaatggcatcggtgagctggatgcggccccaggcgcccggttcggttctttccagttccgcccagatgtcggctgaaagcacataacggcctaccgccatcaaatcggaatccagcgtctgcggctgatccggtttttcgataaactccacaatccggctgactttgccttcattatccagaggttctttcgtctggataacggaatactccgataaatcacctttcatgcgcttcgccagcacctggctgcgacccgtttcattgaaacgcgccaccatcgccgcaaggttatagcgcagcggatcggcggtagcatcatcgataataatatccgggagtaccacaatgaaagggttatcgcccacgaccggacgcgcgcacagaatagaatgccccagccctaacggctgcgcctggcgaacgttcataatcgtcacgcccggtgggcagatagattgcacttccgccaaaagctgacgcttaacgcgctgctcaagaagtgattcaagttcataagaggtgtcgaagtggttctcaacggcgtttttagacgcgtgagtcaccagcacgatttctttgatccctgcagccacaatctcatcgacaatgtactgaatcattggcttgtcgacgatcggtagcatctcttttgggattgccttggtggcaggcaacatatgcatacccaaacccgctaccggtataactgctttcaaattcatcattgtttcttccacctgtaaaatggttgctgaattatagctctttagcttgttttcgccagcatgaattactctgctgccagggataatgatggcacgctctacattacgtcttagtcggcaccataacattaagtatgaacaactttttcccaggaattttcgtaaaaatagcggtacttaccctccccgcttcggcagcgaaaaattcactgcttcgacattcacggtttggtgattaatcctgtcgatatccacggaactctgcccgttttcattgatggcatgaacattagcgagggaaagcagcgtgtcctggcgggccataaattgaccacgtacatctttacgcaaatcgaaatgcatttttaacgccgggccaatcgctgaagtttgcatcacgttgatattgcgcagaaagaggtgctgcggttgattatgcagttccagcgtagcacgcgtcatccgtacattggtgatggcgacaaaagagggggtgttgccggaggaaatttgaatgccgcgtaatttataagcaacctggcgattatccaaccgaatagcgtttaatttaaagttttgcggaattgacaggtattttcctttaacgacgccatagccgatgagcatcccggcactattcgtcatatcaatattatcaatgacgaaattatcacagccataaattgcgatcgttgcgttatcaatacccgcatttttactgaaaccgggcgtgatgtttttggctttgacattgcgaatgacgaaatgtttgccattttctacgtgcacaagctgtcggcaatcagatccggtaatattggccaccacaaagttttttactgcctggtcttcaggataactgttgtcataggtgctacccgccagcccgatgccgatcccccagttgattttgccattggtacaattaatgcgttcgatgacatgatcggaaatcaggatgtcgcggtcgtgaatcgcgacattccactcaatggcgtccccctgtaaatcgctaaagcggctatgcgtaatccgcgcgccatccatttggttatgaaatccctggcggagaatggcgtagttggcgtgggtaacggtgatgtcatcgataatgagattacgcatcacctgcggttccttaccaccgatgaaaatttgcgcgacggggccaaagccgctcatcgccacgcctttaatcacacagtccgacccgcgaacatccagcgtcacattgtgcagactgccgccctgctcccccaccacctgacacccgtcctgcaaaataaaccgtccccggccattcccacgcaccgcgccctgtacccgcagcgtttttcccgccggaatcgttatcgccgcattgatattttcacacacccatcctggcggtacgaccacggtctgtccgtcggcgaaggcctgtttgaacgaggcgataccgtcatccgccggataatccttaatatcgacggtctcgcgaggttcacgcgcctgtaccggcaaggcgcgcagaaaaggaagaacagcaagcgcagaacctgccgtcaggagggtacgtcgggagaatttagtcgcgggcataccacctcgtttatatcgtttgtagcaggctggctaactggcgattaatcgcctgctgattaaaatcttgcgccactttttcacgggcgcgcgtgatcaccgactccagcgtgtcgtggtcaatccggctgaactcagcgagtcgggccgccagcgcctgcgcatcgttttccggcaccagccagccggatttgccggcctccaccagttccggaataccgctatgcacggtagataccacgggaatccctaccgccatcgcctccatcagcgctaccggaataccttccatatcgccatccgtaccggtaatcgacggcagcaaaaaaacatcggcgtcatccagcatcgccttcacttcatggctcggtttaaaccccggcatctcaatgacatcctctagctgatactgctcgatgagcgtgcgcagccgacgttcccacgggccaatccccagaatgcggtagcgaaacgccacgccctgtgctttcagttgccgacaggcttcaatcgccacatgcaggccttttttttctgtcaggcgcgcgacggaaatcatctccagcggcatccctggcgctttcaccgaacgatgggtaaaacgcgtcatgtcgacgcccatgcgcgaaacggcaatcttttccggcggacagcccatacttttcaggcgaccggcccacagatcgctgatgggcagcatcagatcgccacgacgaaacaactgctgatactccggcgtgtaatgactgagcacctcacgactagagatatcaatcccgtggaaaatagtcgcgattttgccgcgaagcacgcccagttcgcgtagtttggccgccgtcacgcccgccggaccaaagtgtgcgataaacacatccgccacaaaaggctggctcacctgcgcgcaaatcgcggaaaggatcaaattgcgtgattcatcgccatagcgggtaaaattgagcgctttccaggtcgccgcccgatgcagccccggcagcgttttacatgcccggtagcgcagtttcgccagccgtccctggggctcatcctgtaaccagcgggttttcgccgccaggccatacttctcccaggcggcgtgagtatgttgggtatcgcctttttgtaacgcgacaatctccacctcatggcccatatcaataaacgcagtaatctgattcagcacaaaggtttccgatgagagtggaaatttcagcagaaaaaagctgactttcattgcgcctcccgaattctgtcgagaacagatttgatcatcgtgaaccctttcgcccgctcctcggtgacggcgttagccacttttgcctttagcgcaggcaattgattgagcgtatcggccaccacgctttgtaatgaaccgttcagcaagtgacggatatcgatggccaattccgccaggcctagctgctgcataatcccggcggatttatgttcataattaatggcgatggcgggtgtgccaaaattcatggagataatggcggaatgcaggcgcgtcccgatggtcagtacgcaggaggcgaggatctttccgatttccacgtcattgagttcgtccatcgcgatatggaaattctctgagtcgtttacatacttcgccatccgtaacgcaaccatccggtcatcgcggttatagcgatcgatactggtgcaggttgacagcgccagtacctgataaccgtccgcaatcaggcgattcacgacctgggcaaatgcctgctcataggcctgctgagtggtgcccaggcgtttatcaaacggctccagatcgcgcaacgtaatcgcgacggttttgcggcgcgcggtgacgtccagccagtgctgcacagcataactggcaacaaactcgtcgtgacggcgttcgactaaccaggcggtatccaccccctgctccactttccgggtatcgatctgcgcggcggtcatcagatcgcggctgacggtttcacgcaggatcagcgcactggtgcgcccaaaaacataattggcgagctggttaaagtcaggattctggaaagggccgacgctatgtcccaccatataaattggtttgttcgccataaacgcgcacagcggatattcaaagtgagtcaaaccgtataagtcgacatagtttgaaccgcccacctgaatgacggcgtcatactgcgcaataaattgcgcgaattcggcaaattccggcgcgatagcaaaattacgcagcgatccttcctgggcgactttagacaataaaattttatgctgaaaacgacggcgtaatacttttttcacccgaccgttaagccctgccgccgcctgctgtttctggcttaactgatacagcgggtcggcaataatcgggcgcccctgcaaccaggcggaactcaccgggaaacggctcatcacatccatctccgcctctggcgcctgttgacggatggcatcaagcaaaccgcgcataatggcgctatcaccacggttgccgcatgtgtggttgcctaaaattaataatttcataaatagcctcttatatccccgtcatccgacacgtaataactttttcatttttgcactgccaacaagctgatttttaatttccatcaccagcgcattgcgtgaaaaaataatcattaaaataaaactcaaaataccgaccataacctgtagcgcgaatacccccgacaacggtaaataaccgtcgaccagctttcctgcgccgtagctggtaataaatgttggcaatgagagataaaacggtagccacaggctgagaatatactgacgatagctggagccgagtaccggcttaatcatcacgaaatagctcagaatggtgttgatgatttgcaccaccaggaaccccagcgtcacgccaatcgcccccgccagatggccgccaatgagaattgccgggataaacagaaacgttttaaagacgttgaacttaaagctgatatccacgcgcgctttcgccatcagcagcgaaccaatcgggttgccgaccgagcgcaacagccccaccacgcacagcaattgcaggatcgggataatgctgttccacttctcgccaaacactaacggcacaaaattgttcgccactaccatcaggcccaacagcgcgggaaaattgataattcccaccacggaaagcaacttatagaagttgacgcgcagcttctcggtatcgtcctggattttggcgaatgccggaaatagcacgcgagtaatgatggggttaagcttcgccggcggcacaacagccacgttgtacgcgaggttatatcccccggcgacgcttgcgccgagaattctcgccagtaccagcgtcgataaattcgtgttgatgtaattgacgatactgtccgccgtcagccacgcgccaaaacgcaggttcgtggacaccgatgccagcgaaaaatgcagccccggacggtaaatcttgcggccaaagtaaccaaacagcagcgttcgcaccgcgctgttcaccagatagccgagaatcgcggttagcgccagcggccagtaatgggcgctaatcaccgtaaaggtgaaccccgccagcacggaggtcgtttcgatcatgccgatcttattgaactccagctctttttgcatcagagcgcggaactgctgcccgtgagggatcacgataaacgccagcgacaacgttttgattaacggcgcgagatccgggttatgcaaaacatgggcaatcgcatcgctcagccaaaagaccaccgcaaataccacaatcccaagcccaacgtttagccagtaaagcgtggtcagctccagatgcccaatcgttttacgctggataatcgagttcgcgatgccaaagtccgagatcgtgtcggccagcgcgataatcaccagcgagacggtcaacaggccaaactggtggttgtcgatgatccgcgccagcaccgtcatctgaattaaccccagaccgataatcactatcgtggcgatagccgaccatttagcgccgctgatcgttttttgtcgtaaactcattcttttctccagaacctgttcacaaggcatcattggcgcagccagattgaatacggacagcgcggaaaaaccggagcgtacacgctgccctggtgcaatatggcaagtaaaatagccttgtgggtcaggttcttaatacgccgctttattaacaaaccctttaaaaatcgtcagaaaaacgattttgatatcgaaccaaatactccattcgcggatgtattccaggtcgaattccacgcgtttttccattttctccagcgtatcggtctcaccgcgccagccattaatttgcgcccagccggtgatgcccggcttcatcttgtggcgtagcatgtaaccttcaatcaactgacgatactgttcgttgtgcgccaccgcgtgaggacgaggaccgacgatggacatcccgccagttaatacgttgataaactgcggcaattcatccagtgaggtacgacgcaaaaagttacctacccgggtgacgcgcggatcgttttgcgtcgcctgggtaacgaccttatcgttctccatcaccttcattgagcggaacttccagactttgatcggcttgccgtccatcccgtagcgcgtctgacggaaaatcaccggcccgggcgagctcaatttgaccgccagcgcaatgcagcacagtaccggtgagatgagcagcagaatcagcgacgccagcacgatatcttctgcccgtttaagcagacggttaatccctgatagcggcgtgtcatatagcggaacgaccggaacgccgctcatctcctccacgcgcgagtggagaatattaaaggtgaacacatcgggaataaggatcaccgagcaggtggtgtcggccagctcgcgcaccagttttttcaccatggcgccgtcgctcatcgacatggcgatataaacattgtgaattcgcgaggctttcgcatcgtcaattaactgctcgaagttcccggcccagtcagcagagacgccgcccggtttgggatcgtgatagacgcccaccacctcaaaacccagccacggctcattacggaagctatccagcaacgcctggcccgcaggcaaatctccggcgacggcgacccggcgagtgttataaccacgattgcgtagccagcccgcgccgaaacgaataaatgaacggcataacactaagcccaggctggacaacgcataccaggccagccaggtggcgaggcggttgtcaaagtcatcattaaacgccaccagaccggcgctgaagatcaggctcagcgtccagttttgcagtaacagcgttaactctgtcgacattttgacgccgcgccaggagcgataaaaatcggttatcccgcccagcatttgaaaaacaaccagcgtaatcagcgccaccaacaggtgcatgtacaggaatggcagtccactgacttcacagatgaaccacagcccgccaaacatgatggtgatatctgaaaagcgttgcaccatagagattaacgatgcattggttttggctcgttcgcgcttttttagatttgtcatcgttgttcctgtgattggccccttacccgcaggcggtaaggggagatctgacgttactgattcagcagcgccagcagagtgcgtgttcgcgcttccatcagcggaatatcgccgcgtgattccacattcaggcgcaccaccggttcggtgtttgacgagcgcaggttgaaacgccagtcggcgaacgacatgctgaggccgtccgtgcggtccactgcctgcgcctcttccgcaaagtgcgcttccacccgcgcaatggccgccgccggctccgccagtctgctgttgatttccccgctcgccgggaacgccgccatccggtcgcgaaccagctcacccagcgactgtctcttcaggcacaccagctccgccaccagcagccacgggatcatcccgctgtcgcagtaggcaaaatcacgaaaatagtgatgcgcgctcatttccccgccataaatggcatcctccgtacgcatccgctccttgataaaggcgtgcccggtttttgacatcaccggcgtcccgcccgccgccgtcaccactgcctccgtgttccaggtcaggcgcgggtcgtggataatcttcgcccccgggtgtttttccagaaatgcttccgccagcagcccgacgatgtagtacccctcgataaactgccctttctcatcgaacaggaagcagcggtcgaagtcgccgtcaaaggcgatacccatgtccgccccgtgttcaataacggccttgcgggtgtcgtcgcgacactccggcagcaacgggttgggaatgccgttcgggaaggtgccgtccggggtgttgtggattttgatgaactccaccggcgcgcccagcgccttcaggcgcgcttcgatggcgtcaatgaccggccccgccgccccattgccggcgttaaacaccagcttcagcggggtgagattgttaacactgatatagccgagcaggtggtcgatgtaggcgtcgcgcaggctgatttgtctgtagctgccgcgcgcggcctcgttcaccggcgggaagtcgcccgcttccgccagacgctgaacgtcgcgcagaccggtgtcgccgcttatcgggcgggcgccctcgcgcaccagcttcataccgttgtagtccatcggattatggctggcggtcacttcaataccgccgtccacgccaaggtggaaggtggcgaagtaaatctcttcggtgccggacataccgatatccagcacgtcgacgcccgcgtcctgtaaccctttcgccagcgccagcttcagcgcctcgctggtcaggcgcacgtcgccgcccagcacgacggttttcggttttaaatattcgccgtaagcgcggccaatccgccacgcgatatcttcattgagctcttcgcccagcctgccgcgaatgtcgtaggccttgaaacaggttaattttgtcatgtgcttccccttcttcaggcaacagttagccctgaccgtaaatggccagcatcgttattgttattcattgccggatggcgcgttgcgcttaccgggcataattgcaggcgtcagacccgcccgtaacgatcctcgaaccgcaccacgtcgtcctcttcgagatacgagccggaacgcacttcaattaaatcgagcggtatttttcccggattttccaggcagtgggtcgcccccagcggaatatagatggactcgttttcaccgagcagcttaacctcgccgttgatggtgactctggcggtccccgccaccaccacccagtgctcggcgcggtgatggtgcatctgcaccgacagtccttcccccggcttgacggtaatacgcttcacctgatagcgctcgcccgcgtcgatggagtcgtatttgccccacgggcggtaaacctcgcggtgcatgtggtgctcatggcgtccgtcggccttgatcttctccaccacctttttcacgtcctgcaccgcgtggcgatcggcaatcagcacggcgtctttggtctgcaccaccaccagatccttcacgccgacggtggtcaccaggccggattcggcgtaaacgtagctgttttccgttttatggctgatgacgtcgccgtggtggacgtttccctccggggtgtgggcgctgatttcccacagcgaggaccacgagccgacatcgctccagcccgcatccatcggcatcaccaccgcgtccgccgttcgctccatcaccgcgtagtcaatggactcttccggacaggcgaggaaggcctcttcatccacacgaatgaagtcaagatccggatcgacgccgcgcatcgcctgttcacaggcggccagaatatcggggcggaactttttcagctcttccagatagcgtccggcgcggaacagaaacatgccgctgttccagtagtaatcgccgctggcgacgtaggcctgagcggtttccagccccggcttctcaacgaactgcgccacctcaaaagccaccgcatccgtcgcgcccggcacgacatcaccgcgccggatatagccatagccggtttccggcagatccggcacgataccgaaggtcaccagtttgcccgcgtcggcatagggcatggcgccgcgcaccgcgtcgcggaaggcctcttcattggcgattgcatgatccgccgccagtaccagcatcagcggatcgcagtccgtatgctggcgcgtcgccgccagcgccgccagcgcaatcgccggcgcggtattgcgcccggcgggctcaagaataatgttctccgtcagcttattgagctggcggagctgttcggcaacgataaaacggtgctgttcgttacagatcaccagcgggctttcgcactccacgccgttcagacggcaaatggtggtttgcagcatggtgagatcgcctttcaggcacagaaactgttttggataaagcacgcgagaaagcggccacaatcggctaccggagccaccggccatcacaaccgggtaaagttttgtctgacgcattatcatccccgaatatctgcaataaattggcgtagcacgttctctttattgagcgtgcgttcggcgtattcacgtgccgtcgtgttgtttttcggcatggcgagcgcctggctaatcccgttgaccagcgcgtcggtcgactccggttccacgcaaacggcgatgcccggatagcgcgcgcaaagttgtcctaattcggtgtgcggctcagcggtaatcaccgcattaccgccgaccgccagaatgttagtcagcttggagggcagtaccgcatccgccgcgccgcgcttttgcaccaccagatggcagtcgcccattttcagcagcgcgggtaaggcgtcgtaaggctgcagcgggaggaatttaatatttgccaggccgcgttcgcgggccatgttctccagccgcgccttgccgcccccctggccgacaatcgcaaaaatcaacggtcgatcgcgtaatcgttccgcggcgtcaattaccttttccagcccttgcttttcgccgatattgccggaatagagcacaatttttttgccctctggcaagccaagctgctgacgcaaagccgtcacgtcagcgtcattaacgtcctgaaagcgcgccacttccgaccagttcggaaaaaagaggattttttccgccgcgacgcccttttcccgcgctttattcatcatggagcgagagatggtcgaaacattatcaacgttacgcagcgcgctgcgttcaaaggccgtcgctaaccgcgctacgctgccgcgcttgccttttcccgccattcctaagccgagcatggcgtccacttcgtaatcctgaatatgcagtacggtacgcgcgccggagagtgtcgccagcagacgcattcccggcgtacaaaagagcgtcggtacaacgccgataatccgatccggcttccagcgacgctgcgccatcagtgggaaaaaactgctcaatgcaaagctccccagatgaagcagtcgttttaaggtggagggctgtttcggcacatacagcgggcagcgccagacggtagcctcgccctcttcccggcgatagcgccaggcggaatagcgctcaccgaccttccactgcgggtagtacggcggcgcagtaatgacccgcacctcatggccttcctgcgccatccacgccaccatttcgccggtatatttgccgataccggtcagttccggcgaatagttaatgccatagaccaggatcttcataggcccaccgccggcgcgtcaggagagaagtaggcccgactgttctcatgaacattgtcgcttgccagaagctgttccggcgtcagccagcggtaactgccatgctgggcatcaggcaggcgtaaatcgctctccgccacgcgcagacgaaagccgagcacgatgtagtgagttgaaaaatcctcaccggaaaagttgtcgtcatagaagtgctgccagacgccataaaacgtccctgccgccagcggcagacgcacgcccagttccgcctgcgtcaggcgtgcaaaggcggcctccagcgtttcgtctttgcacacccgcccccccggcacaaaccagtagccctgcgccggacggttgagacgctggcccagtaaaatttccccctggccgttttccacgatgaaatcgagggagatgaggggcgtggcccgcaccacggcggcgaaatcttcctgacgtaaaaacattgtcacccccggaaccgttgctgattctcaaggaaccactggtaagtaccggcaagccctgcctccagtgaaatttcgtgataccagccaagctgatgcaggcgcgtgacgtcgagcaatttacgcggcgtgccgtccggcttcgcggcatcgaacaccacccggccctggtaacccaccacctttgcgatggtctgcgccagctcgcggatggtgcagtccacgccagtgccgacgttaatgtgcgacagcatcggggcagtgttctcctgccacacttcgcgcgccagctccatcacgtgaatactggccgccgccatatcgtcaacgtgcagaaattcacgcatcggcgtgccgctgccccacaccaccacctccggcgcgtggctctgcgcagcctcatgaaagcgacgcagcagcgccgggatcacatgtgaattgtccgggtggaaattatcatgcgggccgtacaggttggttggcatcaccgaacggtagtcgcgaccgtactgccggttgtaggactcgcacagtttaatcccggcgatcttggcgatggcgtacggctcgttggtcggctccagcgtcccctgcagcagctcgctttccgccatcggctgccttgccagtttcggatagatacaggacgaaccgagaaacagcagtttgttcacgttgtgcaggtgcgcggcgtgaataatgttgctctctatcatcatgttttcataaataaaatccgccggatacgtgttgttggcgacaatgccgcccactttcgccgccgccagataaacctggtcgatacccgccccggcaaagaacgcctgtaccgcgcgcccgtcgagcagatccagctcatcgcgggtgcgcagtaccagttccacgtcgccgcgctgcgcaagctgccgtacaatggcggagcccaccattccgcgatggcccgccacaaaaattcgttgcttattcattctcaggactccagcgcgatggccacctcataaccgtgagatttcaacagtgagtgttttttcgcggcctccagatcgttcgccaccatctcggagaccatctccgacagggtgatttccggtttccagcccagtttctcatgcgctttggacgggtcgcccagcagggtttccacttccgccggacggaaataacgcggatcaacggccacaatcacatcccccggtttcacgcccggcgcatcgtgtccggtaacggataccacgatccctttctcattaatgccttcgccttcaaagcgcagttttatccccagttgcgccgctgccagctccacaaactggcgtacggaatactgcacgccggtggcaatcacgaaatcttccggctgctcctgctgtaacatcatccactgcatccgcacgtaatctttcgcatgaccccagtcgcgcagcgagtccatgttgccgagatacaggcaggactctagtccctgggcgatattggcgatggcgcgggtgatcttacgggtgacgaaggtttcgccgcgacgcggggactcgtggttaaacagaatgccgttacaggcgtaaataccgtaggattcacggtagttaacggtgatccagtaggcgtacagtttcgccaccgcatagggggaacgcgggtagaacggcgtggtctctttctgcgggatctcctgcaccagcccgtacagttcagaggtggaggcctggtagaaccgcgttttcttttcaagaccgaggaagcggatcgcctccagcaggcgcagcgtgcccatcgcatccacatcggcggtatattccggcgactcaaacgacaccgccacatggctcatcgcgcccaggttgtagacctcatccggctgcacttcctgtaaaatgcgggtcaggttggaggcgtcggtcaggtcgccataatgcagatgaaatttcgggttgcagctgtgcgggtcctgataaatatggtccacgcgctcggtattaaacgatgacgcgcggcgcttgataccatgcacctcataccctttttccagcagaaattctgccaggtaagacccatcctgtccggttacgccagtaatgagagcgacttttgacattttcatttcctcaaatagtcccgttagggagtaactttctgaacgcgctggcgcgttaccactgcgggattgccccgacaaatcgcatttgccggtaatgatttaaatacgctgctgcgcgcgccgacgacggtgccatgacctatcgtcacgccgggcgcgacaaaaacatcggtcgccagccaacatttttcgccaataacaatcggcgcggcattaatatcgaaatgggcgctggtataatcatggctaccggtacacaaataccctttttgtgaaataaccgcatgtgcgccaatattaatttcacccaacgtatataacacagcgtcgtcgcctacccaggcataatcgccgacggttaatttccacggataggtaatttttactgacggtcgaataaccacattctttccaattttggcgccaaacagacgcagcaaaaaggctcgccagcgatacaatatttgcggcgacccggcgaataatgtcgcctgtaccgcccaccataattgtacttttagcgcattagcgccgcggaaccccttcggcaccgtaaagccgctaagatcctgcataataactcccggtgattagactttgttataccgcgcttttgttttacccgtcgttttcagacgtaataaataggataattgcgcccaaaatcctggcacacgtaatatttttcgctgtacgttttttgcatcctgacataattccagattattcgaggttgacacgccgcccattgaaaattcagataccagtccgttaattcgccgaaaaggatagcctgctttatagagacgggccgccagcgcataatctgaagagacatgatattgcagatcataaggatacttttttaacgctgccgtcgggaaaaatatcgcctgatggctggctggcaaactatggtagatataatacccgggtttagccttccggcgtattttatgcccgccgccaaaatccagcagcgcgtcgccaatatacatcgcctcgcccttttgtcgcgccagttggcggacaaacagcgcggcatcatcatggaacgcatcaccggaattaagaaacagggtatagcgcccctgcgccaaggcaatgcctttgttcatggcatcataaataccgcgatccttttcactgataaaacgcaggttaaactcaccgtgacgttttcgcagaaattcgcgcgtgccgtcctccgaaccgccatccactacgatccattcaaatgacagacccggatcgcgcgccagattgcgcagcgagcgccaggtttttaccaccccttcgtaattgcgaaaggcgacggtaacgacgcttaaaaacatgcaaccaccccgttatgaaatttttaacgccttgcgcaaaatgaacggacagacgattaaaaaagcatattccgggctaaatattgaaccggtaaaaaacagcgacaccggcgtaaaaagatagagctgcacccgaaaattgcgattatcgccaaacgcatttagcgccatttttaaaactttccccatataccacagcgtcattagcactgcgaaccaggaaaaataaataatcagtagatacaatccattgtctatggttttcccgacatccgcaccgttaaagattccgaatgatgcaacatattcataaagtgagccaaatctgactacaccatcaatatgggtcaaggaatatccgaccatgactaaggggcccacaatacgataataagaagatgagccttccgtccctaaatcgccaagtcgtgtcgcgatataaggaaatgcaataattaccccaaccaaaaacagggttaatgagaccagcgccagtggaagttttttctttatcgcatccttattcaaatattggaacgcccactccagaaggtaaaacaggataaaggtcattacccctgaaaatgatcctgataatattatccctgccagaatcatagcatcgcttttcggtgttttgataccaaactgtttgatgctcagccaaattgagattagtgccaaagcgaaaaatgccggttcaaaataaagcgcagtggtacgcttaccgccaaattttatgaagttcagtacgtagctattactgtaaatgagatatttcgaaattccttccataatactgctgccgccggtaaggataatttgcgccatctccaccgcggcgagcgcgaccaccatacccaccaccagataaaaaaaacgcaaaatctttcggtggttatgcgcggaaatggttttgaatcggatactccagaccatcccgataatgaccacaatatagacaaacagcatcgtggacgtgacatatttaccggcattcagcgactggccgaacaggaagttaaatgccgtaagccccgcgccgatgcctaaggcgatcatcaatttttttacgctaatgcgttccacaaataacagcagcaacagcggtaaaaaagtgacgatggtaatgggaaagctttcccccagttgggcaatcttgacattgaccagtaggtagatcagcggcagcagcagatagctacagattctgatagaacgagacatactcctccagcatctgttgaccgctgtacgcgacgcggctacgcatacgaaaggcgtccagcgtggcgccaaataccgcctgagcaatctctggcttacgccgctgcgccaggcgcagtacatctgtagcggcaaaagtctggccgccggatttcgccagcacctcctgcgccgcctcgctgtgggtggcgattaccggtacgccgatcgagagcgcttcacacaagatcagcggatagttatcgacccgcgagctaaagaccagcgcatccatctcattgagcgcgctcattaatttgcgcttatcggtttcaaaaccgtgattaacaacgttttggccggtaaaaggcgaaaatttaccgaaggtatgcagttcaattttttcgcccagcgccatcatgtcgtgtaccagacgctggtcagttttgccgtcataacgcaagtcatgcgccacaatggcaattcgcggttttcccggattcagcggcacaggtgatagctgcgcgagaatcgcctcggtcgccagatcgataccgttgttaataatctggcagcgccccgcgccataaacgctgttaaaggcctcggccacgtgctggctcggcgaaataaaccggcagcccagccgcagcatgtcccgaaagcgctgacgtttgccgtcaataagctggtgcgcccgatccaccctaaccggcggataattgcttagggtcgggcatttttggcagccgcttttccagccctcgcaaccgtcggtgaaggcgcaacgcccggtgacgctccagtgatcgtgcaacgtccagaccagcgtgacgtctggtttttgcgctttgactttttcgcaaaacgtcacgatgtccgccaggtttagccagtaactgtggagaacatgaaaatgcagcaccagcgggccggatgtctggataaccgtgcggtaaagattgtcgagattgccaaacagatcgcgattcaggaaacgaaacagcgcgatattagcgattgccgtgccgcgcggcgtctgttttatcacctgcggataacggtggtggctgacgcttttttttccgcctttgccataaccataaacaaaatgcgacgtcagccctttttgcagcgcccgcagatggagatccaacgccactcccgccgcgccgccttccgccagccgtacattaaattgcagaatattcatgtgctgaccttcacccgtgctttttctcccaccaccagcgcatgatccggaatactgtcaagcaccacgctacccgcgccaatcgtgacgtgattaccgatagtaatatcgccaagcaggatgacattcgcccccagctcaacgccgttaccaatcaccggacaagccaggctgtccgcgccgcgattgccaatggtgacgccgtggcgaatggtaaaatcgtcgccggcgacgacatgtttgttgatcactaccgcgtaaccatgatggatagtgaaccgccgaccaatggtcgcggcggcctggatttcatacccgaacaggcattccgtgatcacgcgatacagcaccagcaccggcgcggcccacagattattcagcacattctttttgcgccagacggaacaaaaatgagcgatacggtaggccagcaccatgcaacaggggcgtaagctccagctattcgcgcgtaagtcttccagcatcgttatcgcccccgcagcccggccgccagacgtttgctattacgcacggagagcaacgtcagcaacgtgcgccaggtcattcgcttattgcgaatttggtacagggtaaaaagctggtattttttactggcgcgatcgaatttatctttgtgcttacgataaaaatggaaatagccggagaactttttcggcgaagaggtaatctgcatctcgccgtggttgatatgtaaaatttgcgtcgcctcttcgactttccacggttcgccatactccaccaccatgcgcagaaaaatgtcgtagtcctgcgccgccttgagttcggtatcgaacaaacacgctttaaaacgccaggcccaggtaaaaacctgattgccaataatattgcgcttgtagaataagcggcgcgaataaggggatttcggatacagcggcaggctggcaggctgagagtagacctcgccctcgcacacatagtcgttggcatacaaaaaggcgtgcgtagtcaactggtgtttatgggccagaaacacgctcagacggtttggcgtccattcatcgtcatcatcaataccggtaatgtagtgcccttgcgcctgcataatggcctggttgcgaaccgcgcaggcgccggtattcctggcgttatgggtataacggacgcgcgggtcgttcagctcctcaacaaattgttgtagctgctgataagatgaagagcaatcatccacgatgatcatctcccagtgacggtagtcctgacgtagtactgatttaatcgcccggatagccaactgctgcctgttccaggttggcatataaattgagatcagcggattgtctgttgtcatgcttattccccagatagttttgccgcatggcgctacgcttgtccggcctacagtctcaggccgcgccatccggcacgccttattttttatttggaatctgactggtattcatactcgtaatagccataatcctggtagcccgtcgcccggcggaaaatggagttgagaatgacgcctttgacctgaatgccattctggtcaaaacggctcagactggtttccacctcttttaaggtgttgacggcataacgcgccaccatcagcgtcgtcccggcgtggcgacccacaatcgcggcgtccgtcacggccagaatcggcggcgtgtcgattaataccagatcgtagcggctgcttgcccaggcgatcagctcgccgaagcgctcgctcatcagcagttccgatggattaggcggcacctgaccgcgcggaataagatcaaaattagcgatcgccgtgggtttcgcgcaggaggctatctcgcctttgcccgccagaatgtcagataagccgtccacgttattggtgccgagcagttcatgggtgtagcccttacgcatatcgcagtcgatcagtaatacccgtttatgcgtctggctgatgacggccgccaggttggcgcaaacaaaggttttgccgatagagggactgacgcctgtgagcatgagtacattattttgcgcctgcatcatggcgaaatgcaggctggtgcgcaggctgcgaatcgcctcaatcgccagatcggtcggattgcccaccgccagcagttggctctgcttgtaacgcttaattcctttaatggttttgacgctatcgcgcgctttttgccattccgacagcggaatactggcatagacgctgatcccgtgctcctccagcgcctgcgggctttcgataccgcgattaaacagcgagcgcagcagcacgccgacaatcgataacattaatcccagaataatgctgccgagaataatcaacgcctttttcggcttcagcacgcccggctgggtaatcgccgggtcaacgatgcgcacgtcgccaacggtgctggcttcggtgattttcagctcctgctgtttattaagcagttgcatatagacctgctggccggactccacatcgcgggtcaaacgcacaatctcctgctgggttttcggcattgccgtcacccgcccgttcagtttggctttttcatcttccagcgctttacgtttttccagcagggtgcggtaagccggatgcgctttggtaaagagcttggaaatttccgcctctttaaacgtcaactcattcaactgggcgtcgatattaaccatcgaatcgagcaccgccttcgcctccagcggtaaatccaccgagtctttatcctggcggaaagcgtttagcttgttttccgccacatccagacggctgcggacttccggcagttgttttgccagaaacgccaggctcttccccgcctcttcagatttccgcgcaatatcctgttgcagatagttacgggtaatactgttgagaatttcgcggatctggtcgcgatcctctcccgtgaacgtcaggctcagaacgccggtatctttgccggtttccgttacggtgaggttattttgcaggttattaatcatgccaagcgttgagaatttactcaccgtaaattctgtatcaggacgggcgtcaatcgcctctacccgcatcgtcacgccgtctttattgagtggctggcccacaacgccctgcgcgctaaatccgccgtcgctaaccaactgataacgtttgtcgcccagcactttgagggtgaagatctgtccgctcatcgtctctggtcgggtgaatgtcgtgactttcaccatttcattgtgacgtcccatcagccgttcccacccggcgccgaacagcggaaaggtgtttttggtgacggcaatatccagatccagatcgtcaacggtcttccccagcaccaggcgcgatcgaatgagctgaatttccgcatcggaagccggcggcttattcgctaatgcgctattgatatcctgtaccagcgaattaccggcgttttgttcaatctgtaccagcgcatcggcgctatagatgggcgtggcgaagaacgtataaattaccgcgcacagcgcaaatatggccgtcgtccccaacacccaccaacgcgcttcaatcaccgttccgaccaggcgcccgatatcgatttcatcgctacccgtaaccgccgcagattgttttgctttttctgtcatggttttccctgctctgcattcagtgcctgcgcccactggcgggcagacctttccagtaatgtgtacaccgcctcaaacgcatcgcggcttttgcgatacgggtccggtatttcacgctcgctgtcccagtgaccaaacagcattaccttgccgcgcatttccggcgcaatgtcgcacagggcggcgatgtgacgtttctccatcgtcagaatcaggtcatattcccggcacagacgcgcggaaatttgccttgcgcagtgattttccaaagacagatcgtgggcgctcgccacgctcgccgccgcaggatcggcgcctttgccgaccagtgcgcctaatcctgcggacgcaaccgtcagcgagggatgaaagcgttttagcaaacgttccgccgtcggggaacggcaaacattccccacacagaccactaagattttgttaaacataacgattaccaggaatgaatgtcgctggccgtatccgtcatataacggacaccgctaatggttggcagcaactgattgatcagacggttccagcgagcaaccggcgcggtcgtgacgtacaccacatcgtaaggctgaagtcggaattccgtcgccatcaccaatgacgtggcgtcagacatatcaagctggtagatattggcgatcttgccgccgcgtcccccctcgcctttcaacggacgaatcacaaaaatgccgctggcgttggaggtggtcagatcaatgccttccgcattgcctaatgcttcggtgagcgtcatgccgctgaaatccattttgagggtgctctgttttttcacttcgcccatgacaaagactttcagatcgtcattgcgcggcacatacagaatgtcgccagggtagagcaagcggttctggctaagatcgccattttgcatcagcgcctgtagcgaaatgcgctgttctttgccgttgtgcgtcaacacgacgttgcgccagtccgccatatcggtcaggccgcccgcagcgttaatcgcatccaggacggttagcggtacgttagtaatagcctgctgaccggatttattcacctggccggagatgtacgctttttgcgagcggaaagcggcgatattgacatccacctgcgggtccgcaatgtacttcgctaaacgcccggtaatatcgctacgaatctctgacaaagttttaccgacgacgctaaccttgccaatgtagggataaaacatggtgccgtccggctgtacccagttgccggtatcgcttgagctacggtactggcctgctggcgtggtcaattccgggtgatcccagacggtgacattcagcacatcgccaggcccgacgcgatactgatagctggcgatctcctggtccagcgacatattcggttgcgcgacattgggccgcgggcgtaattgctcaaccaaccgtggcgtcagcggatacacattgaccatccggtcgagatcaaagtcagcgtcttgctgtttgatcacatctttccccatcgtagacatattgctgcccggaagtactgtgcaaccacttatcaagctgagcgacgccaataatggcatcaatttcattttggatttcatcattgattatttatcactttggcagagtcattatcctgtgcaatttaaatagcggcttcgtccgtgcacatttaccttgcagttaatagcagagaaaattaactggcatcattctgaaaaaaaatcaattcatccgcaggctattgacagaataataaaggcttatattcaggctttcaggcacgctaccgcccctggcttcttagctaccaatacactgattattctaaattttcgcattcccctcagattttatcctcgttcagataaaaatcttcagcgaaataaaggttacgtattaatagttttctcgatgtcgtgacaggatatttaagcgcgctatcttaatcctgcaagaattgttgcagctaacctaatgacaggcaaggtaacaaacccgccattctatatttttaagattaatattaaatgaattaacagatgattttaggattttattgatgttgacaatatttatttactccactccacctgcgatatttcctaaatatattcttgacattatttagtttctgacagaaacattacggctattttaaagttattttatagccgcgtaacaaagataaattgcgctgcggcattgcatttttccgccgtattatccatgatcgaattgtgacaattgtcatattacagaaggtattgctcttactatggaatggattgccgatccgtcaatctgggccggactggtaacgttaatcgttatcgaacttgttctcggcattgataacctggtctttattgccatcctcgctgaaaaactaccgccggggcagcgcgaccgcgcgcgcattaccggcctgatactggcgatgatcatgcgcctgctgctgctggcgtcaatctcgtggctggtcaccttgactaagccgctttttagcgtacaggcgttaagctttagcgcccgcgatctgattatgctgttcggcggcttcttcctgctctttaaagccaccatggagctcaacgaacggctggaagggaaagatagcgccaaccctacccagcgtaagggggcgaaattctgggcggtggtcgcgcaaatcgtggtgctggacgctatcttttctctcgactccgtgattaccgccgtggggatggtcgatcacctggcggtcatgatggcggccgtgataatcgccattagcctgatgctgctcgccagcaagtcactgacccgatttgtgaacaaccatcccaccattgtcattttgtgtcttagcttcctgctaatgatcggctttagcctggtggcggaagggtttggtttccacattccgaaagggtatctgtacgcggctatcggcttctcggtgatgatcgaggcgctcaaccaactggctatttttaaccgccgccgttttctttccgctaaccatacgctgcgccagcgcacaacggaggccgtgatgcggctgattagcggtaaaaaagaggatgccgaactggatgcggaaaccgccgcgatgctggcagaccatgacgacagccagatttttaatccgcaggagcgcaggatgattgagcgggtgctgaatctcaaccagcgcaccgtaagtagcatcatgacgtcgcgtcacgatatcgagcatatcgatctcaacgcgccggaagcggaaatccgcgctctgctggaaaagaaccagcatacgcgtctggtcgtgacgggtgaaaatgaacaggaagatttactcggcgtcgtccacgtcatcgatctgttgcaacaatcgctgcgcggcgaaccgctcaacctgcgggcgctgattcgccaaccgctggttttcccggaaacattgccgctgctgcctgcgctggagcagttccgtaacgccagaacccattttgcctttgtcgtagatgagtttggctcggttgaaggcattgtgacattaagcgatgtcatggagactattgccggtaatctgccgaatgaagtcgaggaaattgacgcccgccacgatattcagaagaacccggacggttcctggacagcaaacggccatatgccgctggaggatttggtgcagtacgtgccgctaccgctggatgaaaaacgggaataccatacgattgccggattattgatggaatatttgcaacgcataccgcaaaccggtgaagaggttcaggtgggcgattatttgctgaaaacattgcaggtagaaagccatcgagtgcagaaagtgcagttaattccgctgcataacggcgagccagaccaggagatgtaacgtctgttcgcctgccccggtctgcttaccaggcaggccggaggcgcgttagcctcgccatccggctctgccctttggccaaaaactacagcttattcagcagcttcttcacatctttaccgttgcgggtatctttattgcgatccgcccagtcattgagccgacgcttcgcctcatcctgtaaatgcttacgcaataactgatccacttgcagggtatagttcagctcctgccacttgccatagacgcgcaacggcaccggcgtctctttcaggaaggtgatcaggttgctatcgccgttccagccgcccagcacacgcagattaaattgtgtatcacagctctgcttaaccagatccagcgttccgctgccggttaacgccagcatagaagattgcccgaccatgtcgtcgagcgtcagcgtgcccttatttagcgtcagatcggtcgtgaagcgatccagtcgggtcgcgttgtccatattttcctgcgactgctgcgcgtcgccgccgcttcgctctacggcctgctgcaccagttgctggaaattcattccttcaaggcgcgtattgctcatgtcaacatgcgcttttcctttccagctatggcgaaatgcctctgcgtcaatatccgccccggagaaatcgccaaccagcgacatcttaccggtcaggctaatcggataattgaaggctttcaggatagtcccaatctcaacatggttgaggcgagggtggaattcgatgcgcggactggcggtgcgggcgtccagcgtgccgggcagcgacatctctccgtcggccagtttcccctgcaaatcagtaatatccagcaatccggcctgattagacatcttcgtcgaaacctgggtaaagtccattccccgccagcgaactgaatccgcctgtaaagcaatctccgccgtaaagctttgcagcccctgataaggcggcgcaccaacacgcgacgcgataactggcctggtcagggggagcgtattttgcccctgcgacaccgcgccgcctgtctgagccacggcgctatgatgcggcaacaggttgtccagattaagcttgctggactggaggtcaatttgccattccggctgctccgccagcgttacctgaacttgcccggtcagagaactgtcattcgccgttaaatttaagtggttaaatgaaagacgtttttgcgcctcctgccactgcgcctgcaattgtccctgcccctcaatcccctgcgctggtagatccgcgccctgcaattgccagcgcagttgctcaatacccgcggttaaattatgcgggtaatcggaagcatccaccgttccgctgaacgataaagcaagatcccgctgatcgcggttcacgcgtcccgaaaaatcaaacgtgccgcgatgctcggcatcttgttccatattcagacgaatatcgcgcaccgtgacctgatcatcattttcatgctggaaaaccagcacgctgtcggcaacgcgcaggctacgaatatcaaacgaccagccgcgatcttccgctacgtccggcaaggtattatctttcggcgcgaccggcgcatcatcgctgcgtaccgcttccgtttgcggcgtcagttgaatcaccccgcctttcagcatcacctgcttaacatgaagctgatgactcaatagcggccataaagcaacatccaggcgcatattgtcagcccgcaccagcggttcgctggcgcctcgcgccgttagcgtcattcgcccggaaaggatactcagttgcggccatacgtgccagcgcagcggcccgtcaagttgcaactgatattcactacgcgcggcaacctgctgcaccatataggcgcggaaatcattcggattgaccaacaataccaacgcagagaatccggccaccagcacgaccaggagaatcatcagcgtcgtcagaaatcgtctcatgctaccctcaatggaccggcagtattgcgccgaatggctcagtctttatcaatccggctggcgacagcgccctgctgatcgcgatatttggcatcctgacggcggttataaggccgcgccgccgggccggacagcggctcaaaactcagcgcgccgatgagcatacccggacgcaacgccagcggcagcttcccggagttgtaaaactcaagcacaatgcagcccgaccagccgggatcgatacggtgcgccgtcacatgcaccatcagccccagacgcgccagcgaggagcgaccatccagccagcccactaaatccggcggcagggtaacggattcaaaggtaacggccagcgccaactcgcccggatgcagataaaatgcctcgccgtccggcaaaacgatttcatcgctcatcacgcgatccagcgccgcgctgacctcatctttaggcccgctcagatcgataaacgccgccgtatggccacggaaggttcgaaatttattgccaagacgtacatcgaccgtcgcgccgttaatgcgctctacgggaggtcgcggggtgatagacaaacggccttcatccagccaggcttcaatatctcggtcgcataaacgcatggcactttctcctttcgcgcatcaagcccttaaatcaagcacatcaagggctaaccaggttatcactgaacggtacacaattcgccagatttattcaaagaactggctgattttcgctttcagaatatcaatagcgatgcggtttttaccgccgcgcggcacgataatatccgcatattgtttggaaggctcaataaattgcaggaacatcggacgcaccgttttctgatattgcgccatcaccgaatccattgagcgaccacgctcgttcacatcgcgtttgatacggcgcatcaaacagatatccagcggcgtatcgacaaaaatagagaagttcatctcttcacgcaaacgcgcgtcggtcagtaacagaataccttcaagaataatcactttcttcggttctacgcgaaccgtttcctgcatacgggtatgctcaacataactgtataccggtaattcaatcgccgaaccgcgcttgagcgcctgaagatgctgaaatagcaggctgtgatccatcgcattcggatggtcatagttagtttttacgcgttcttccatcgacagatggctttgatctttgtaataactgtcttcgggaataacgccaatatgttcgtcacccacttgttcacgcaattcgcggtaaagggtactggcaataagactcttgccggaagccgatgcgccagcgataccgataatgacgcactgatgagactgatcagtcataaatttagcgacctgattaacctggatgtaaggaaggggggcgccgaaacgccaaacgcggcaattatagggatttcagcagcgcgataccagtccggcgctatgccacggtgaatttgttggcggcgcattcgacgtcgcgacgtaaaagcgttcagttttaacgcgggcagcggttttatcgacccgtctggaggaggaatacgccgggagccacaatttatattcagccagcgtataaatcattacgcgtttatactagcataatcacagagtaaactgacgcgtccggtattccgcgacgttaccggcgattcggatagagtggtaatgagtaaaccatcccaacatgttttcgttaccgtcccccacccgctattgcgtctggtcagtttaggcctggtcgcgtttgtctttacgctcttttcgctcgtattatcgcgtgtcggcacccaactcgcgccgctgtggttccccacctccattatgatggtcgcgttttaccgccatgcgggccgtctgtggccagggatcgcggtcgcctgctcgctcggcagcatcggcgcctcactgactttatttcctgccgcctcgcttaactttagctggacggcaataaatattatcgaggcggccactggcgcgatactgctgcgaaaactgctccccagctacaaccccttacaaaatttgaatgactggtttcgtctggctatcggcagcgccgtgattccgccgctactcggcggcctattattttggctaatagcgccggaagcggtcgcctcgaaagcgtttctgatttgggtattatcggaagccatcggcgcgctgacgctggtgccgttaggtttactgtttaaaccacactatctgttgcgtcatcgcgacccgcatctgttgctggaaacgctattgacgctggtcattacgctggcgctaagctggctcgctatgcgctatattccgtggccgtttacgtgcgttatcgtcctgttgatgtggagtgcggtgcgcctgccgcgaatggaggcgtttttaatttttttagctaccgttatcgtggtctcgctcatgctggccaatgaccccacgctgctcgccacgccgaaaaccgacgtgatggtcaatatgccgtggctgccttttttaatgatcctgctgcctgccaatatgatgacgatggtgatgtacgcgtttcgcacggagcgtaaacatatcaccgagagcgaatcccgctttcgcaacgcgatggagtattccgccattggtatggcgctggtcggtacggagggtcagtggctacaggtcaataaatctctgagccattttcttggctatagccaggatgaattacgcacgatgacatttcagcaattgacctggccggaagacctgaataacgaccttgaacagctaaacatgctggtgcgcggcgacatcaacagctattccatggaaaaacgctactacacccgcaacggcgatgtcgtctgggcgctgctggccgtctcactggttcgtcataaagacaataaacctctctattttattgctcagattgaagacattaacgatctcaagcaaagcgagcaggaaaaccagcggttgatggagcgtattacacaggcgaacgaggcgctgtttcaggaaaaagaacggttgcacatcacgcttgactctatcggagaagcggtggtgtgtattgatgtcgcgatgaatatcacctttatgaacccgatcgccgagaagatgagcggctggcggcaagaggatgctttaggcacgccattattaacggttctgcgcattacgtcaggtgataaggggccgctgctggaggatatttatcgcgccgacaggtcgcgatcggacatggaacaggagatagtgctccattgtcataacggcggcagctacgatattcattacagtatcacgccgctcagtacgcttgatggcgataagattggttcggttctggttatccaggacgttaccgaatcacgaaaaatgttacgccagctcagctacagcgcaacgcatgacgccctcacccaacttgccaaccgcgccagttttgaaaaacagcttcaacagcgcctgcaaacaatacaggaatcgcctcaacatcatgcgctggtgtttatcgatctggaccgttttaaagcggttaacgacagcgcgggacatgccgccggcgatgccttattgcgtgagctcgcgtcactgatgctcagtatgcttcgatccggcgatctcctggcccgtctgggtggcgatgagtttggcctgttgctgccggattgtaatagtgacagcgcgcgctttatcgcgacgcggcttatcaacgccattaatgagtatcactttatgtgggaaggacgcctgcatcggatcggcgccagcgccgggatcacaatgataaatgaacataactgccagctcacagaggtcgtgtctcaggccgatattgcctgctacgccgcgaaaaatagcggtcgaggccgtctgaccgtgtacgaaccgcagcacgcattaacctcctcaaagggaatgatgccgctggaagaacagtggcatatgattaaaaataaccacctgctgatgcttgccagaaacgtcgcgccgccgcgtacgccggaggccaccagcttttggctggtctcactcaggctgtggaccagcgaaggggaagtgatggaagagcgcgcgttccgggcagggttagccgactccgcgctgcatcacgcgcttgaccgacgggtattccatgagtttttccaccatgcggcgaccgccgtcgccagcaagggattaagcgttgcgctgccgctgtccgccgcgggattatacagcgcgacccttattgatgagctgctggaacaactggagcatagtccactgccgccacggttattacacctgattatcccggctgacgttatcgttaagcaggcgcagaccgccgctgcgactctgcgaaaactgcggcaacgcggctgccaggtgattctcagccatgtcgggcgcgatttacagctgtttaatttactgcccctgcatatcgtcgattatttactgctggatagcgaccttatcgccaacgttcatgaaagtttaatggatgaaatgctgacctcgatcatccagggacacgcccagcatctggacatcaaaacgctcgccgggccggtacaaaacccacaggtgctggatacgctctcccgtattggcgtggatctgatttatggcgacactatcgccgaagcgcaaccgctggatttgttactgaataccagctatttcgctatccattgacggttgccagccgtgggtataccagatatgcagtagcgcgtaggaacgccacggtttccagcgctccgcgtagcgacggatctgcgcgggcgtcatcccggcgaagcgctgcttaattaagtaatcatcgggcaaaaagatatcttttgcctgccaaccgcgcagggcgaaatagttcgccgtccagcggccaattcccggaaacgtttgtaaatttttaacgctctgctcaatatccggcggcgcggcgagcgccagttttcccgccagcgtcgcctgcgccagatgaatcagcgcttcggcgcgccgcagcggcatccccagagctttaagcgccagcggatcggccaacgccagcgtttccggaccgggaaaacagacataatcgggcgcatccggcaacgcctcgccatagcggcgcgccactttcgccgtcaaccttgccgccatcgcgacactcaccagttgccccagtatcgcccgcacgccctgttcaaacgtatcaaccgatcccggtaaacgcagccccggtctgtcctcgcccagtggccccagcacggcggcaacctgcgcgggctggcagtcaagatcaaacagacgcgaaactttcgccagacacgccggcgcgacgggaagtaatccggcgctcacgctaacctgcacagtgtgggtgggcagatggggcctcacgctgaccagtccgcgatgctcgcccaccaccaggctgcgcgcataaaagccctcgcctactgtttccacgccgtccaccgcacgcgcggcaagaaagcccaacatccacgaccagtcgtaaggcggctgccagctcagggtaaacatacttttctcctttatttgacctttcagcataaacgctaatcgcacgtaacgccttgctttcatattccagttgtcgccgcgacgacatttcgctaaagtcacgccccttcttcactggcatggggattttaaggtgtttatcggatttgattacggtacggcaaactgctcggtcgccattatgcgcgacgggcatccacagttgctgacaatggagaataacagcgcattactgccgtctatgctgtgcgcgccgacgcgcgaagcggtgagcgagtggctgtatcgccatcatgatgtgccggcaacggacgaagaaacccaggcgctgctacgccgcgcgatacgctacaaccgcgaggaagatattgaggttggcgcgcaaagcgtacagtttggtctggcgtcgctggcgcactatattgacgatccccaggaggtctggtttgtcaaatcgccgaaatcctttttaggcgccagcggcctgaaaccgcagcaggtcgcgctgtttgaagatttagtctgcgccatgatggtacatattcgtcatacggcgcacagccaattgccggaggccattacccaggcagtgatcggtcgcccgatcaactttcagggactgggcggcgatgacgcgaaccgccaggcgcagggtattctggagcgggcggcaaaacgcgccggttttcaggaggtggtattccagtacgaaccggttgcggcgggcctggactacgaggctacgctgcgggaagagaagcgtgtgctggtcgtggatattggcggcggcaccaccgactgctccatgctgctgatggggccgcagtggcgtcagcgcgccgatcgtgaaaacagcctgttggggcacagcggttgccgcgtgggcggaaacgatctggatatcgcgctggcctttaaaaatctgatgcctttgctgggcatgggcggcgaaaccgaaaaaggtatcgccctgccggtgctgccgtggtggaacgccgtcgcgattaacgacgtcccggcgcaaagcgatttttacagtagcgcgaatggtcgtctgttgaacgatttggttcgcaacgcgcgtgaagcagacaaggtcgcgttgctgctcaaggtctggcgtcagcggcttagctaccgcctggtacgctgcgcggaagagagcaaaatcgccctttccggccaggcggatgttacggcgaggctgccatttatcagcgacgacctggcggtcgctatcagccagcaaggactggaagcggcgctggatcaaccgctgacgcgcattctggaacaggtgcaactggcgctggacagcgcgcaggaaaaaccggatgtcatctatctgaccggcggcagcgcccgttcgccattgattaaaaaagcgctttccgaacagttaccgggcatacccgtcgctggcggcgatgatttcggctccgtcaccgcaggactggcgcgctgggcggaggtcgttttccgctaagcgcctcgcaagcccagcgctgatggattgacattattcttgatgtggcttaacgtcaggagtgagggtaagggaggattcctcctccccctggtgtcttagtaagctggtaggctaatcactaagagtatcaccagtatgatgactaccttcatcataaccctttccttattttggccccttcctcgggaggggctttcccgtttcagcgtcctgctgaaatcggtggcttaccttcattgccgtgccgccactttaccgcactccggcgcgttaacgattttcaccgatgagagttgcgtagcgcctcgcaaagcgggtcgccattcagaataatcccgaccgtgttccataattcctccatttttctcccttccctgctgactacaatagaggaagcaacattccgcaaaacgtttcaggatgagaaacttataccgatgaaaggcagtaatactttccgctgggcaatagcgattggggttgtagtggccgccgccgcattctggttctggcatagccgtagcgaaagcccgaccgccgcgccaggcgtcgccgcgcaagcgccgcataccgcctccgcaggtcgccgcggtatgcgcgacggccctctggcgccggtacaggccgcgaccgcgaccacgcaggccgtaccgcgctatctgagcgggctgggtaccgtgaccgccgcgaataccgttacggtgcgtagccgcgtggatggtcaactcatcgccctgcactttcaggaaggtcagcaggtcaacgcaggcgatctgctggcgcaaatcgatcccagccagtttaaggtcgccctggcgcaggctcagggacagttggcgaaagataacgctacgctggcgaatgcgcgtcgtgatctggcgcgctatcagcaactggcaaaaaccaatctggtttcccgtcaggaactggatgcgcaacaggcgctggtcaacgaaacccagggaaccattaaagcggatgaagctaatgtcgccagcgcgcagttacagctcgactggagtcgtatcacggccccggtctcgggacgcgtgggtctgaaacaggtggatgtcggcaaccagatttccagcagcgataccgcaggtattgtcgtcattacgcaaacgcacccgattgatctcatttttactctgccggaaagcgatatcgcgaccgtagttcaggcacagaaagcggggaaagcgctggtcgtagaagcctgggatcggactaactcgcacaaattgagcgaaggtgtgttgctcagtctggacaaccagattgatcccacgacgggaacgatcaaaattaaagcgcgctttaccaatcaggacgatacgctgttccccaatcaatttgtgaacgcccggatgctggtcgataccgaacaaaatgccgttgtggtgcctgccgcggcggtgcaaatgggcaatgagggccactttgtgtgggtgctgaacgacgaaaataacgtcagcaagaagcgggtaaaaatcggtattcaggataaccgaaacgtggtgatcagcgcaggcttatcggcaggcgatcgcgtcgttaccgatggtattgatcggctgacggaaggcgcaaaagtcgaggtcgttgagccgcaaaccaccgtggcggatgaaaaatccccttcccgccatgaaggtcaaaaaggagcgcgcgcctgatgcaggtattacctccgggcagcacgggcggcccttcgcgtctgtttattctgcgccccgtggccaccactctgctgatggcggcgattttactcgccgggattatcggctatcgcttcctgcccgtcgccgctttgccggaggtcgactaccccactattcaggttgttacgctctaccctggcgccagcccggatgtcatgacctccgccgtcaccgcgccgcttgagcgccagttcggccagatgtcaggactgaagcagatgtcgtcgcaaagctccggcggcgcgtcagtggtaacgctacagtttcagttgacgctgccgctggacgttgccgagcaggaagtacaggcggcgattaacgcagccaccaatttattgccttccgacctgccgaatccgccgatttacagcaaagtcaatccggcggacccgccgattatgacgcttgccgtcacctcaaactcgatgccgatgacccaggtagaggacatggtagaaacccgcgtggcgcagaagatctcacaggtctccggcgtcgggctggtgacgcttgccggcgggcagcgccctgcggtacgcgtaaaactgaatgctcaggctgtcgccgcgctcggtctgaccagcgaaacggtccgtaccgcaattaccggcgccaacgtcaactcggcgaaaggcagtctggatggccccgaacgggcggtgacgctttctgctaacgatcagatgcagtctgccgacgaataccgcaggcttatcatcgcgtatcaaaacggcgcgccggtacggctgggcgatgtcgccaccgtcgaacagggggcggaaaatagctggctcggcgcatgggcgaatcaagcgccggctatcgtgatgaacgttcaacgccagcctggcgccaatatcattgcgacagcggacagcattcgccagatgctgccccagcttaccgaaagcctgccaaaatcggtgaaggtcacggtcctgtccgatcgcaccaccaatattcgcgcttccgtgcgcgatacccagtttgaactgatgctggcgatcgcgctggtcgtcatgattatctatctgtttttacgtaatattcccgccacaattattcccggcgtcgccgtaccgctgtcgcttatcggcacctttgcggtgatggtgtttttggatttttccattaataacctgacgctgatggcgctcactatcgccacgggtttcgtggtggacgatgcgattgtggtgatcgagaacatctcgcgctacatcgaaaaaggagaaaaaccgctggcggcggcgctcaaaggcgcgggtgaaatcggctttaccattatttccctcaccttttcactgattgcggtgctgatcccgttgctctttatgggcgatattgttggtcgactgttccgcgaatttgcggtgacgttggcggtagcgattttaatctccgccgtcgtctctttgacgctcacgcccatgatgtgcgcgcgtatgctcagccagcagtctctgcgtaaacaaaaccgcttttcccgcgcctgcgagcggatgtttgaccgcgtgatcgccagctacggacgtggattagcgaaagtgctcaaccatccgtggcttacattgagcgtggcattcgccacgctcctgctcagcgttatgctgtggatagtcattccgaaagggttctttccggtacaggataacggcattatccagggaacgctgcaggcgccgcaatcgtcatcgtatgccagtatggcgcaacgtcagcgccaggtggcggagcggatattacaggacccggcggtgcaaagcctgacgacttttgttggcgtagacggcgctaaccccacgctgaatagcgcgcgcctgcaaattaacctcaagccgctggatgcgcgtgatgaccgcgtgcagcaggtgatctcccggctgcaaaccgccgtggcgacgattcccggcgtggagctgtatctccagccgacgcaggatttaaccatcgacacgcaggtcagccgcacacagtatcagtttaccctgcaggccacgacgctcgatgcgctcagccactgggtgccaaaactgcagaacgcgctacagtcgttgccacagctctctgaggtaagcagcgactggcaagatcggggattagcggcctgggtgaatgtcgaccgcgacagcgccagccgtctgggtatcagcatggcggatgtggataacgcgctctacaacgcgttcggacaacgcctgatttcaacgatttatacccaggcgaaccagtaccgtgtcgtgctggaacataataccgccagcatgccgggcctggcggcgctggagacgattcgcctgacgagccgcgacggcggcaccgtaccgctcagcgcgattgcccgcattgagcagcgcttcgctccgctctccatcaatcatttagatcagttcccggttacgacattttcgtttaacgtgccggagagctattcgctcggcgatgcggtgcaggcgattctcgatacggaaaaaacgctcgccctgccagcggatattacaacgcagtttcagggtagtacgctcgccttccaggcggcgctaggcagcaccgtctggcttattgtcgccgccgtggtggcgatgtatatcgtgctcggcgtgctgtatgagagttttatccatccgattacgattctctcaacgctgcctacggcgggcgtcggcgcgctgctggcgctgatcatcgctggtagcgagctcgatattatcgccattatcggcattattttgctgatcggcatcgtgaagaaaaacgccatcatgatgattgacttcgccctcgccgccgaacgcgaacaggggatgagtccgcgcgacgctatcttccaggcctgtctgctgcgttttcgaccgattctgatgaccacgctggcggcgttgctcggggcattgccattaatgttgagtaccggcgttggcacggaattacgtcgcccgttggggatcgcgatggtaggcggcttactggtcagccaggtattaactctgtttaccacaccggtgatttatctcctgtttgaccgcctgtcgctgtacgtgaaaagtcgctttccgcgccataaagaggaggcgtagatgcgctttttcgcccttttcatctaccgcccggtcgccaccattttgattgccgccgccattacgctgtgcggcattctgggctttcgtctgctgccggtcgccccgctgccgcaggtcgatttcccggtgattatggttagcgcctcgctgccgggcgcctcgccggaaaccatggcttcgtcggtggcgacgccgttggaacgctctttgggacgcattgcaggcgtcaatgaaatgacctccagcagctcgctcggcagtacacgcattattctcgaatttaatttcgatcgtgatattaacggcgcggcgcgcgacgtgcaggccgccattaacgccgcgcaaagcttgttgccaggcggaatgcccagccgcccgacttatcgcaaggccaacccgtccgacgcgccgattatgattttaacgcttacctcggagagctggtcacagggcaaactgtatgatttcgcctctacccaactggcgcaaaccatcgcgcaaattgacggcgtcggcgatgttgacgtcggcggcagctccctgcccgcagtacgtgtaggcttaaacccgcaggcgctctttaaccagggcgtctcgctggatgaggtccgcgaagcgatcgacagcgccaacgtacgccgaccgcaaggcgcaattgaagatagcgtccaccgctggcaaatccagaccaacgacgaactgaaaaccgccgccgaatatcagccgctgattattcactataacaacggcgcggcggtacgcctgggcgacgtcgccagcgtcaccgactcggtgcaggatgtccgtaacgccgggatgacgaacgctaaacccgctattttgttgatgatccgcaagctgccggaggccaatattattcagacggtcgacggcatccgggcaaaactgccggaactgcgggcaatgatccccgccgctatcgatttacaaatcgcccaggatcgttcgccgacgattcgcgcatcgctgcaagaggtagaagagacactggctatctctgttgcgctggtgatcctggtggtgtttttattcctgcgctccgggcgcgccacgctaattcccgccgtcgccgttcccgtttcgctcatcggcaccttcgccgccatgtatctgtgcggcttcagcctcaacaatctgtcgctgatggcgctgactatcgcgaccggatttgtcgttgatgatgccattgtggtgctggaaaatatcgcccgccatctggaggcgggaatgaaacctttgcaggcggcattacagggtacgcgagaagttgggtttacggtcatctccatgagtctgtcgctggtggcggtatttctgccgctgctgttaatgggcggcctgccaggacgattattacgggaattcgccgttaccctctcggtggcgattggcatttcgctggtggtctcgctcacgctgacgccgatgatgtgcggctggatgcttaaatcaagcaaaccgcgcacccaaccgcgtaaacggggcgttggccgtctgctggtcgccttgcaacagggttacggcacgtcattaaaatgggtgcttaaccatacgcgtcttgtcggtgtggtttttcttggcaccgttgcgctgaacatctggctttatatcgccatccctaaaacattctttccggagcaggacaccggcgtgttgatgggcggtattcaggctgaccaaagcatctctttccaggccatgcgcggcaagctgcaggattttatgaaaattattcgcgacgatccggcggtgaataatgtcactggttttaccggcggatcgagggtgaatagcggcatgatgtttattacgctgaagccgcgcggcgaacgcaaagagacggcgcagcaaatcattgatcgactgcgggtcaaactggcaaaagaacctggcgccaggctgtttctgatggcggtacaggatattcgcgtcggcgggcggcaggctaacgccagttaccaatatacgttgctgtctgactctctggcggcgctgcgcgaatgggagccgaaaatacgcaaagcgctctcggccctgccgcaactggcggacgtaaactccgaccagcaggataacggcgcggagatgaaccttatctacgaccgcgacaccatgtcacggctgggtattgatgttcaggccgcaaacagtctgttaaataatgctttcggccagcggcaaatttccaccatttatcagccgatgaaccagtataaagtggtgatggaagtcgatccgcgctatagccaggatatcagcgcgctggagaaaatgttcgttatcaaccgtgacggaaaagcgattcccctctcttatttcgcccaatggcggcccgccaatgcgccgctgtcggtgaaccatcagggactttccgcggcgtccacgattgcctttaacctgccgaccggcacatcgttatcgcaggcgacagaggccattaatcgcaccatgacgcagcttggcgtcccctcgacggtacgcggcagtttttccggaacggcgcaagtcttccagcagaccatgaattcacagcttattttgatagtggcggcgatcgctaccgtctacattgtgctggggatactgtacgaaagctacgtccatccactgaccattctctctactctgccatcggcgggcgttggggcgcttctggcgctggaactcttcaatgcccctttcagcctaatcgccctgatagggatcatgctattaattggcattgtgaagaaaaacgccattatgatggtcgattttgcgcttgaagcgcaacgaagcggcggcctgacgccggaacaagccattttccaggcctgcttgttacgcttccgtccaataatgatgaccacgctggcggcgctgttcggcgcactgccattggtgttatctggcggagacggttcggaattacggcagccgctggggataaccattgtcggcggtttggtcatgagccagctcctgacgctctataccacgccggtggtgtacctctttttcgatcgtctgcggctacgtttttcgcgtaaaaatagcaaaccggtagtagagatatgacagaacttcctgacaacacccgctggcaactctggattgtggcattcggcttttttatgcagtcgctggataccaccatcgtcaacactgcgctgccctccatggcgaaaagcctgggggaaagcccgctgcatatgcacatggtagtggtgtcatatgttcttaccgtcgccgtaatgctccccgccagcggctggctggcagataaaatcggcgtgcgtaatatcttctttgccgccattgtgctgttcacgctgggttcgctgttttgcgccctctccggcacgcttaatcaactggtattagcgcgggttttacaaggcgtaggcggcgcgatgatggtgccggtcggacgcctgacggtcatgaaaatcgtgccgcgcgcgcaatatatggcggcgatgaccttcgtcaccctaccgggacagatcgggccgttactcggccccgcgctgggcggggtgctggtggaatatgcttcatggcactggatctttctgatcaatatcccggtgggaattgtcggcgctatggcgacctttatgctgatgccaaactacatcatagagacccggcgctttgatctgccggggttcctgctgttagctatcggcatggcggtactcacgctggcgctggacggtagtaaaagcatggggatttcgccctggacattagccggacttgctgcgggtggcgcggcagccattctgctctatctcttccatgccaaaaaaaactcaggcgcgttattcagcctgcgattgttccgcacgcccacgttttcactagggttgctgggcagttttgccgggcgtatcggcagcggtatgctgccgtttatgacgccggtctttttgcaaattggtcttggtttttcaccgtttcatgccggtttgatgatgatccccatggtgctgggcagcatgggaatgaagcggattgtggtgcagatagttaaccgttttggctatcgtcgggttctggtagcgaccacgctcggactggcattggttagcctgttgtttatgtcggtcgcgctgctcggctggtattatctcctgccgctggtactgcttttgcagggaatggtgaactcggcgcgcttttcttccatgaacaccttaacgctaaaagaccttcccgatacgctggccagcagcggcaatagcttattatcgatgattatgcagctctcgatgagtatcggcgtcactattgccgggatgctgctgggtatgtttggccaacagcatatcgggatagacagtagcgccacacatcacgtctttatgtacacctggttatgtatggcggttattatcgcgctaccggcgataatttttgcccgcgtgccgaacgatacacagcaaaacatggtcatttcacggcgtaaaaggagcctgtaatgaaagtctggcggcccggaatcaccggcaagctgtttctggcgatcttcgccacctgcatcgtgctgctgatcagtatgcattgggccgtgcgcgtcagttttgaacgcggatttattgactatatcaaacacggcaacgagcagcggctacaaatgctgggcgatgcgctgggcgaccagtaccagcaacacggcaactggcgttttttacgcaacaacgatcgcttcgttttccagattttgcgttcatttgagcatgacaacgaccgcgataaacccggccccggtatgccgccgcacggttggcgcacccaattctgggtcgtcgatcaaaatggccgggtactggtcggcccacgcggtccggtgccgcatgacggtactcgccgtcccattctggtcaatgacgtcgaagtcggcgcgattatcgcctctcctgtcgagcggctgacgcgcaatacggatattaattttgatatgcagcagcggcgcgccagttggatgatcgtggcgttatcaacgttgctggccgcgctggcgacatttttgctggcgcgtggcctgctcgccccggtcaaacggttggtcgaaggtacgcacagactggcggcgggggattttaccacgcgcgtgactccaaccagcgctgatgagctgggaaaactggcgcaggactttaaccagcttgccagcacgctggaaaaaaaccagcagatgcgccgcgactttatggcggatatttcccacgaactgcgcacgccgctggcggtattgcgcggcgaacttgaagccattcaggatggcgttcgccagttcacgccagaatcggttacctcgctacaggcggaagtcggtacgcttaccaaactggttgacgacctgcatcagctgtcgttgtctgacgagggcgcgctggcttaccaaaaaacgaccgtcgatcttgttcccctgttggaagtcgctggcggcgcgttcagagagcgctttaccagccgggggctaacgctacattacgcgttgccggatagtatgaccgtcttcggcgacccggatcgcctgatgcaactgtttaataatctactggaaaacagtctgcgctacaccgacagcggcggcggcctgcatatttccgccgaacaacgcgacaaatcattattcctgacctttgccgattctgcaccgggcgtcagcgatgaacagttacaaaagctttttgaccgtttttaccgcacggaagtgtcccgtaaccgcgccagcggcggttctggactggggctggcaatatgcgtcaatattgtacacgcgcataacggtcatcttcacgccgctcattcgccttttggcggggttagcattacagtagagttaccgctggatcgcgatttacagagagaagtatgactgaattacccattgatgaaaacacgccgcgcattttgattgttgaagatgaacccaagctgggacagctgcttattgactacttacgcgcggcgagttacgcccccacgctcatcaatcatggcgacaaggtactgccgtatgtgcgtcaaacgccgccggatctgatcctgctggatctgatgctgccgggtaccgatggtctgacgctatgccgggagattcgccgtttttccgacatccccattgtgatggtcacggccaaaatcgaagagatcgaccggctgcttgggctggaaatcggcgccgatgattatatctgtaagccttacagcccgcgcgaagtcgtggcccgcgtgaaaaccattttgcgccgctgtaaaccgcagcgcgaactccagcagcaggatgccgaaagcccgttaatgattgatgaaagccgctttcaggcctcctggtgtggtaaagcgctggatttaacccccgctgaattccgtctgctaaaaaccttatcgcttgaaccgggtaaagttttttcccgcgagcagttgttaaaccacctctacgacgactaccgtgtggtgaccgaccgtaccatcgacagccatattaaaaacctgcgccgtaaactggaatcgctggatgccgaacagtcatttatacgcgcggtctacggggtgggatatcgctgggaagcggatgcgtgtcgcctggtataatgattattggcataacaataacaaggtcgtaagacgatattttccgccaacgctattctggcggaattaacacactgccctctttcctttggccgagcggtatcccgaaaaccacgacgaacgcgatcggggacaataaattatttggccgctctttttagtttaccgatatactgtgagtagttttttaaacttattgcgcattaattcattaagtgaatctaaaaatacataaacataataccagcttaattatacatggatttttatgacagaaacgtcatctcaccgctataaaccacgcaatataataaatgcgccaaatgtaaaatcgtctattttttcccggagccaacaacgcggcgacagcgaaattatccagcgctggttaagcaaccatttttatcgttggatcattggtgactttcctcatgtttatcctgtgcgctccgtcgccgattatgccgtttattttagcgctgatgcagaaatccccgcctggctggcgccaaagctgggtggcgatgagcgcttttactaccttaacgttcagcacccgcaacttgtggcgatggaaagagatttagtggaatttctttcgcgtcaggaaggaacgcggctggaaactaaactacagcgtatcaactgctttaccgtgctggcaatgcgcgaagcggagcatcaaaaaatgcagcgcctgcgtgaacaaggttggtatccctccaacagcgaggcgctaaaaccggtgatgacggtgaataacggcgtactggttgagcttgatgcaacaaaccccggcctgcgcagtgagatggcgtatgaatcctggcatatgcaacactgcgtcggagattttgataataaaggcgcgctttccggcggctacggcgattactacgcccggcaaattgaacaacagaaacttcgcctgttcagcctgcgcgacggcaataatattccccacgttacaataagcctggtggttggtaataacggcctgagcattgatcagattaaaggtaagcaaaatcgccatcctattaagaaatatgctaacgatgttttatctctgttacgccatctgcaaccacttcctgagcgccacgctgattgcgaagggatgggaatagtttatgaattgacgccggaatattcaggttggaaatttattacgcatattcatgacctcaattttctgctcaatgtgctgcatgacaattttcacttaatggaacacttccccactcccccggtagctttacagtggctgctgctgcacagcgccccggaggcgctgcgctaccttcaggttgttgatcctaacgtggcgacggctgcggaaatgctgtttccgcagcatgaatggcatcctacgcttgccgggaaaaacaccagtagcgaacctttcgaaattgaaagcctgacgctacaaaccacgcgctacctccctgtcatcaaggaggtgcaataatgttctggattgttcttattattgccgccctattttttagctggcgcaactacaaaaaaaacaaaccgctgattgcagcccgtatcgccgaggagaaagaaaaagatcgcctgaaagacctgcgtcgcgatacccgacggcggcaatgggcgctggcgctagctgatatcctcgcccggcgcaacgggctaccgatcaaaggcgttgagctggtatttaaacttgacgatgacaaacgccgctatctggcgcagcaggtaaaaaaagagctgggcttgagcgaaaacctcgacggcgcggcgttacgccacaaggtcgaggatatcttacgccgctggcctgcgggcatcggcagctcgccgcgcacgttttatcatcatctggcggcccagggccaggtccgcgacgcgctggctttcgactgcatgcgcaccgcctttctgacccgctgtatcgccgggctcggctggtgcgacgtacatcaggcctggctggtgttattacttaacgcccagcgcgctcaggactgttttgattcctgggaggattacgccaccgcctacgttcgcgcccgccgggtatggctcacgctacgtgacacgccaacagcgcttgccggacgggatttacaggaagccacccattatctgcaagaccctgtcagccgctggcgacaactgccgtggaatgaattcaaaattttcgagccgatttaaaggacgctttatggaacaggatgatcgtctgctcaacgctatgtttgagatgtgcaaccacaaaaatcccctcaatgacgggcaacgagagtggcatatcgccgatattcccggcctgctgcgcgaagaacgctatgacgaactggacgaacgctacaaccaggcgctgacggagagctttaccagccgcgaagcggaaaagcgctatttcttcgcctggaatcaaatggacaaccctttttacgatatggacacgctggttgaggctgggccgcaaggattagcgctgatcaaaaactggcagcgcgcccgtcctcgctccactcacgcctggcttgccgaggcgcaatactggaatcaccgtgcgtggctttaccgcagctatggctgggcgagagaaaccacccgagcgatgtggatctgcgccgccgcctgcaacgaacggatggtcatcgccgcgctcaatgccatcgactgtgaaccgcgccagtggatggcggcggccctgaccagcaccaactcaaaagtcttcggccagcccgagtggctggttgagttcctcgtgggcgcggatgttgccgggcagccattaatggaagatctggctgaatatcatcgccattcaccgcaggaggtggacgcgctgatggcccattccgggttgtcgtttaccgacgcggtttgcccaaatttgccgcgcccgtccgtgctgccggagtgcaatgacgatgccgggcaaaaatactggctcgccgtctgcctggctattttcccgacggcattttacgtgctggatgaatatatcccgtttcgtatgccacgctggagagggtctcacgaggaaatccgcgaatttctggaatcaagcgtatgcgatcacctttctgccgcagaacgtgaacatctggagctattgatctggtgggacgatcaccgcgatctgcgcatcaaagaggttgactccccggcagaacaggaacgtattatcgccaaagccgaagagattagcctgcgagcgcatatccaggaatctcgccacaacgcgctggagtggctgcgggtctgctatagcgatctggacgataatgacgcgctctggcgaacccttcagcgttcgatcgtggaaaaagttaagctcaacaattacttctctgatgacacgataaagttcgccctgcgcgattttcctgacacctggtggatgtataattttctctgtcagaatgcgcagcaaacggaattcgcagtgccgaaaatccgtcgtggctactttcagtacgccgggttattgggtttcgaaaaggatgaggcgcaaggcctcgcctggctcgatagcgtcgccgacattcaatataaccataactggcgggcggcgattaaaaatttcgactggttcgggctcccggaacatttcgtgccgctggcagagctgggcgcacaaagaaatatacccgccgcgctaaacttgctgggccttgaacacaataataaagagaacaacggcctactaccttacgatcctgccatcgcgttagggtattttcagcgcgcggcggagattttgcaccggcagttagcgctgcgcgagagcaccccgtacaaattaatagataacggaggctataccgactatgaaaatgacctgcaaaatattcatttcagcattggcatctgcaaccagcgtctgagtaaacaagaacctgataccgaaaaacgttccgcttatgaaaaagaactactcgataatctctggctggcgcatcagttcgggcataaagaggcctggggcttgttcctgctgaatatttttgaagtgaaggatattacgctggcgcataagcatctggaactggtgcaacaagaggccaacaaaggcacgctacatgctatggtgaccctatcgcgcctgcacggtaataaacacgatcgaacgctgtttaatatgaagctaagcgcacgctgggcgcattttgccttcacactttacccggataatgaaatcgttatggactgcctggaccacctgcatttcgattctttctggaaacgctttcgtttcgcctggtataccgtccgtatcccgaattcagagctgccgggacaggtcaactcaatggtgtaaggtggtttactcccctctcccacggcgctacaatgcccgcccttaaagtgaggactctcctcaagccgcctcatcaggtgaggcggatctgacctgtcatcagaacgagaaaatgatgtttaaaccagaactcctttcgccggcgggaacgctgaaaaatatgcgttacgctttcgcttacggtgccgatgccgtctatgcgggccaaccacgctactctttacgcgtgcgtaataacgaattcaatcacgaaaatttgcagcttggcatcaacgaagcccacgcgctcggaaaaaaattctacgtggtggtgaacatcgccccgcataacgccaagctcaaaacctttatccgtgacctgaaacccgtcgtcgagatgggcccggatgcgctgatcatgtccgatccagggttgattatgctggtacgcgagcacttcccggcaatgccgattcacctgtcggtacaggctaatgccgtaaactgggcgacggtaaaattctggcagcagatgggactgacccgcgtgattctctcccgcgagctgtcgctggaagagattgaggaaattcgccagcaggtgccggatatggaaatagaaattttcgtccacggcgcgctatgcatggcctattccggccgctgcctgctttccggctacatcaataaacgcgatccgaatcagggcacctgcaccaatgcctgccgttgggaatataacgtgcaggaaggaaaagaagacgttgtcggcaacatcgtgcataagcatgaaccgattccggtacagaacgttgagccgacgctcggtatcggcgcgccgacggataaagtgtttatgatagaagaggcccaaagaccgggcgaatacatgaccgcgttcgaagacgagcatggcacctatatcatgaactcaaaagatttgcgcgctatcgcccacgtggagcgcctgacgaaaatgggcgtccactcgctgaaaatcgaaggccgcaccaaatccttttattactgcgcccgtaccgcccaggtctaccgtaaggccatcgacgacgccgccgcgggtaaacccttcgaccctacgctgctggaaacgctggaaggtctggctcatcgcggctataccgaaggtttcctgcgtcgccatacgcacgacgattaccagaattacgagtacgggtactccgtttccgaacgccagcaatttgtcggcgagttcaccggtgagcgtaaaggccaactggcggccgtggcggtgaaaaataaattctccgttggcgatagtctggagctgatgacaccgcagggaaatatcaatttcaccctggaacagatggagaacgccaaaggcgacgctatgccggtggcacctggcgatggctataccgtctggatgcccgtcccgcaggacgttacgctggattacgcactattgatgcgtaatttctcaggcgaatcaacgcgtaacccccatgctaagtagttaattgcggttattttttcatggcgggaagattcttagaaattgatcacataccgcttcgctcaatgcgggtattattcaacgcgctgaaaaacataacccataaatgctagctgtaccaggaaccacctccttggcctgcgtaatctcccttacgcaggcttattttttgcgtataatccataaaaaagtggtacttcccgccatatccaaaattgaccacactaaccaaagcgcaaatgggcgcttaggtttagagacctcccctatccattgccagccagcaagtcacaatcctccccgcatccggtcggactcaggacttagcattgtgacgttaacgtttaaaatcagtgaattaaatcaataactactttgtgagcacttacacaaaaagtttccaggttattaaattaaggttaaaaactgataatttaagcgtgtaaaaatatggcacgttttaatgccgcttttacaaggattaaaataatgttttcccggattagaggtttgatttcatgtcaaagtaatactcaaaccatcgcacctacgctcagtccaccttcatcaggccatgtaagttttgctgggattgattatcctctattgccactaaatcaccaaacgccgctcgtttttcagtggtttgaacgcaatccagatagatttggtcaaaacgaaattcccattatcaatacgcagaaaaacccttatcttaataatattatcaatgctgctataatagaaaaagaaagaattatcggtattttcgttgatggcgattttagcaagggacaaagaaaagcattgggaaaattggaacaaaattatagaaacataaaggttatttacaattctgaccttaattatagcatgtatgataaaaagttaacgacgatttatttagaaaacatcaccaaactggaagctcagtcagcaagtgaacgagatgaggtcttgcttaacggggtaaaaaaaagcctggaagatgtcttgaaaaacaatccggaggaaacgcttatttcatctcataataaagacaaaggtcacttatggtttgacttctacagaaatcttttcctgctaaaaggaagcgatgcctttctggaagctggtaaacctggttgtcatcatctgcaaccaggcggtgggtgcatatatcttgatgcagatatgttacttactgataaactcggtactttgtatttacctgatggtatcgctatccatgtaagtcgtaaagataatcatgttagccttgaaaatgggattattgctgttaaccgcagcgagcatccagcattaataaaaggactcgaaattatgcacagtaaaccttatggcgatccctataatgactggctcagtaaagggttgaggcattattttgacggttctcatatacaagattatgacgcattttgcgatttcattgaatttaaacacgaaaatatcattatgaacacaagcagtttaactgccagttcttggaggtaatcatgatagccttgttttactcacccttcccaccgtcacgtataatcggtatccagagttattcctttatcctgtaaaatgtgatacagattctccattgatctaataactacctcaatttcacattcaagtttctctacagaactttcattgagtgagaagttgagagccagtaataatgattgtgagttattatcataacacaaatgtggtccattattctctgcaaaccataaattagcattgagaaattcaaaagcaagattattattatccggaggttttccgcaaaaaccgtatatcattatatactcactgttagtgcttgttagtaagatacggtaacggttatctataataaatgagcataatctgttttcgtcaaagacaattgaatcggtatttaattttagtgaaaactgtcttaataagcgatcggctcttgaatacataacaccccatactctatctaaagcgtttctatataagtcataagcctctggtctggacgattaacacctcgtgtcatcgtcggaattcgtcttttccctatgacttgctgtgtttgctcatttatggccaggctggccgggttctgatgccatttgcgctaaggtatagtccggcgcatattcccatcataccaattccccccatgccaaacgatgcgcctaaaaccgtcagagcggtagtatatgccgcaccactactgacactggcgacagcccctgagcataccccactgaaaacacttgtaaacaatgccgtggttcccaggcacattaaacatctgggtttattgccgtaagcgttaaaatcaacgatttcagctaccggtttttcgtcattaccccgttcagaaggagggagcaatggcgtttgcgcattcacgcctgaagtgacattcatataaacctcttcatgcacatgcctgtttatgtttatgagaaaagcgatacatcaggcaacggtacgactataggacaccgcgctaagccatcatctaaataggttttatttgatatatagtagcgtgcttctaatagtgcgccgtgtttctgctaaagagtctaaagaacatttcgattttatgctattaaaaagtatgtttggtaataaatatcaggtttttatctgatattatggtgtttgaaattaatactgataactgacgtatgttcgtcttgttaattctccgtttcgttatcaaaggcgctatatcggaaagcgtctgactaccccttgtgatttccttgcactctcacaagcgctactcaatgcgcataccggcatctctcttgtcgccatttgccttaaaccatgcttcgcttaccgctgcgtacagcaggaagaaaaacggtaaagcaataagtgcgcaacatttcaattttcatcctgttctgacctcgctttttcatttctgctatacactttctggagattgttgttcaacctattaaggcataacggatggctaactttcccgccagcttactgatcctcaatggcaaaagcgctgataaccagccgctacgtgaggccattactctacttcgcgacgaaggcatacagattcacgttcgggtaacctgggaaaaaggcgacgcgcagcgttacgttgatgaagcccgtagactgggcgttgaaacggtgattgccggcggcggagacggtaccattaatgaagtgtcgaccgcgctcatccagatccgcgacggcgtagcccctgcactgggccttttgccgctcggcaccgccaacgattttgccaccagcgccggtattcctgaagcgctggacaaagcgctgaaactggcgattgccggaaacgcgatggaaattgatatggccatggtcaatgataaaacctgttttatcaatatggcgacgggcggttttggcacccgcattaccaccgaaacgccggaaaaacttaaagccgcattgggcggcgtctcctatcttatccacggtctgatgagaatggatacgctgacccctgatcgctgcgaaatacgtggcgaaaactttcactggcagggcgatgcgctggtgatcggcattggcaatggtcgtcaggctggcggcgggcagcaattatgtcccaccgcgctgattaacgacggactgttacagctacggatttttaccggcgaagagctgttgccggcgctgttttccacgctcacgcagtcagatgacaatccgaatattattgacggcgcctcagcgtggtttgatattcatgcaccgcatgaaatcacgtttaatctggatggcgaaccactcagcgggcaagaatttcatattgaggtgctgcctggcgcattacgctgtcggctgccgccggactgcccgttgctacgttaataacacctgtcgctggccggatgcgctcacatccggcttttcttcgttgaactcaggcgatggtgactttgctatccagatagacatcttgtacggcgttaatcaacttcacgccatcagccatcgatttcttaaaggctttacgtcccagaattagccccattccaccggctcgtttgttgatcaccgcggtacgaaccgcgtcgccgaggtcagtgtcgccgccgtccgcgccgccggagttgataagcccggcgcgtcccatatagcagttcgccaactggtaacgtaccaaatcgatcgggttatcgctggtcagtttgctgtacacgcggtcatcggtatagccgaagttgactgctttataaccgccattattctcggccattttctgtttcacaatatccgcgccaatcgtagcggccagatggttggcttgccccgtcaggtcagcggatacatggtaatcaacgccgtcttttttaaaggaagaattacgcaggtaagcccacaatacggtcaccatacccagctcatgcgcacgctcaaaagctgcggagatctcttcaatctggcgacgagactgttccgaaccgaaatagatcgtcgcgcctaccgccacggcacccatattgaacgcctgctcaacgctggcgtacagggtctgatcgtactctgtcggatagctcaatgtttcgttgtgattcagtttgaccaaaaacggaatacggtgcgcatagcgccgtgaaaccgaggccagtacgccgtaggtagaggccacgcagttacagccggcctcaatcgccaattcaacaatgttttttgggtcaaagtagcgcgggttagccgcaaaagaggcgccggcggagtgctccaccccctgatcgacgggcagtatcgaaaggtatcctgttcccgccaggcgtccagtattatagagcgtctgcatattacgcagaacggctggtggacgattattgtcaatcatcacccggtcaacataatccttgccgggtagataaagctgatcggaaggaatggtcatacaacgatgctgtaaaaggctgtcggcgtctttgccaagcaactgcgcaatatcagtcatagctatgctcccgtaagttccgatagggtatcggaaggtgaatagtcctgccccgcagattgcgggtcgcaataagcctggtactgaccgaccatttttgccaactttagcgcattttttcggcgctatctgctgactcgattcacgtccgaaaaagtgttagatcggtcaaaattaatgctcaatggtatttaaaaggtattattaaatggtattgtcatggcgtaccttacctgtcatgaaggattcaaaaatgaaaacgacctttaaactgtcgttcatgatgttcgtggagtggtttatctggggcgcctggttcgtccccctgtggctatggctaaataaaagcgggttttccgccggtgaaataggctggtcttatgcctgtaccgccattgcggcgatcctgtcgccgattctggtcggctccgttaccgaccgttttttctcagcgcaaaaagtcctggcggtactgatgtttgcaggcgccgtgctgatgtatttcgcggcgcagcaaaccaccttcgccggattctttccgctgcttctggcctattcattgacctatatgccgaccatcgcgctgacaaacagcattgccttcgctaacgtaccggacgttgaacgcgattttccacgcattcgcgttatgggaaccattgggtggattgcctccggcctcgcctgtggattcctgccgcaaatgttaggctataacgatatttcccccaccaacattccactgctcataaccgccgcaagttcagcgttgctgggcgtatttgcgttctgtctgccagacacgccgccaaaaagcaccggcaagatggatattaaagtgatgctggggctggatgcgctggtcctgctgcgcgataaaaactttctcgttttcttcttctgttcctttctgtttgcgatgccgctggccttctactacatcttcgctaacggctatctgacagaagtaggaatgaagaacgccaccggctggatgacgctcggccagttctctgaaatcttctttatgctggcgctgccctttttcactaagcgctttggtattaaaaaggtattattgcttggtcttattaccgccgcgatccgctacggcttttttgtctatggcggcgcggagacgtacttcacttacgccctgctgttcctcggtattttgctgcacggcgtaagttacgatttctactacgtcaccgcctacatttatgtcgataaaaaagcgccggttcatatgcgtaccgctgcgcaagggcttatcaccctctgctgtcagggattcggcagcctgctgggctatcgtctcggcggcgtgatgatggaaaaaatgtttgcttatccgcaaccggttaacggtctgacattcaactgggcgggcatgtggacgtttggcgcagtgatgattgccgtcatcgcgctactgtttatgattttctttcgcgaatcggacaaagagatcactgctattgacgatcgcgatattgcgttgacacaaggggaagtaaaatgaaagcagaacgtattctcggtgctctttacgggcaagcgttaggggatgcgatgggaatgccctctgagctgtggccgagaacgcgcgtcaaagcgcatttcggctggattgaccgctttctgcccgggccaaaagaaaataatgccgcctgctattttaaccgcgcggagtttacggatgataccgcaatggcgctctgcctggccgacgcgctactcgaatgcgaaggcaacattgatcccgagattattgggcgtaacatcctcgcctgggcggaacgctttgatgcgttcaataaaaatgtactcggcccgacgtcaaaaatagcgctgaatgcgattcgcgacggcaaacccatcgcggcgctggaaaataacggcgtgactaacggcgcggccatgcgcgtttcgccgttgggctgcctgttgccgccaactaacctgacagcctttatagcagaagtggcgttagcctccagcccgacgcataaatccgatctggcggtggctggcgccgtggttgtcgcctgggccgtctcacgagcggttaacggcgacacgtggcaaagtattgccgactcgctccccgccgtcgcccatcaggcgcagacagcgcgtattaccacgtttagcgcctcgctatcggcacgtctggaactggcgctaaacattgtccgccatgccgacggcgtcgaatctgccagcgaacagctctatcagatcatcggcgcgggaaccagcaccattgaatcggttccctgcgctatcgccatggtggaactggcgaataccgatcctaaccgctgtgccgtgctgtgcgctaacctcggcggcgataccgacactatcggcgcgatggccaccgccatttgcggcgcgttgcacggggtaagcgccattaacccccagttaaagcaaacgctggacgaggttaatcagctggattttgcgcgctatgccgttgcgctggcgagttatcgtcaacggcgggaggcactatgaacggcgcacggttgctgacattattaccgaccctgcatacccggcgtccgctcaccgttatcggcgcggcagtgatcgatatcattgccgacgcctggacgttgccgcgtcgcggaggcgatattgaactgcaacaacagagcgtcaatgtcggcggctgtgcgctgaatattgccgtggcgttgaaacgactggggattgacgccagcaatgcgctgccgctgggccagggcgtgtgggcggagaggattcgccgccgtctggcaaaagagggattatccagcgtgattgacgcggttgaaggagataacggctggtgtctggcgttagtcgaaccggatggcgaacgcacgtttatgtcttttagcggcgtggaaaaccagtggaatgcagactggttgtcgcagctcaggacaccgcggggcagtcttgtctacctgtccggctatcaactggcctcgtcctgtggcgaaccactgatccagtggctggaaaccgtcgacgatgtcacgccttttatcgattttggcccacgaatcggtgatattacagacgatgcaatggcgcgcattatggcctgccggcccatcgtctccctcaatcgccaggaagccatcatcgccgcggaacgcgccggacttgcgaccgatacgcgcactttcggcgaagcatgggtaaaccgcttttccgcgccgctggtggtgcgccacgataaagacggagcgtggtattttagcgcgcaatcttccggcgttgtgccagcgtttccggcaaccgtggtggataccatcggcgcgggcgacagccatgctggcggcgtgctggcaggactggcgtcaggctggtcgctcgcggatgccgtactgctgggaaatgcggtggcgagctgggtggtcgggcatcgcggcggcgactgcgcgcccacgcgcgaggcgctactcctcgcacacaaaaacgtataggtcgctacgacaataactgatgctgtattcaataggccgctgctgctgatcgagcgccacctgcttaatcaccagcaccggcactttaccatccatttgaatatgcgactgaaactcatcatccggcatccgggcgctgacgcgggatcgggtacgctgagggtaaatgtgctggcgacgaaaatagtcatacagagaaataccaatcgcgtcgacatcatgaatcagatgcgcgggcacccaggactcttcaatcgataccgcgtcctcatcaacataacgaatgcgtttgagtaaaaagacgtcgctgcctgcggggatcgccaggtgctgcgcgacctcatccggacaacttaccacgcgtttgttaacccatagcgtatccggttttttgccgcgcaagacaacctgctgagaaaatccccgcgcctctttcagggaatattcaaagatattattgatttgcgtaccgtagccgcgggcgcgcgtgacaacaccctcttcttccagcgcctgcatcgcttttcgtaccgtgatgcgcgagacgccggtaagctggctgagatcgcgttcgccaggcaaaatattaccgtgctcaagaataccgctgcgcacggcatcctttaccgtctgggcgaatttcatgtatagcggcgtattatccgccgctgaaattcgttcattcagttgcgcgatgagccgggtatgcgcttgttccatttatctttcctgacgacgggtctgtaggcagtatactaccaccacgcgtggaaatgatgtaccggaccaatgcccttccccacttccagcgtgtccgcctgcgccagcgccgccgaaagccatgccttcgcctcgtttaccgtctctccccaactgcgatgccggggccgtaacgccgccagcgccgccgacagcgtacagcccgtcccatgcgtatttttggtgttcacacgcggcgcgctaaaacgctgctcgccctcgcgggtaaagagccagtccgggctttgcgcatcctctaaatgcccgcctttcatcaataccgcttcacaccccatcgccagtaacgcccgcccctgcgccagcatctcctgttccgtacgcgcatggggcgcatccagcaacgctgcggcttccggcaaattaggcgtaatcagcgatacctgcggcaacagccggacgcgtaatgtttctatcgcagagggcgagagcagcggatcgccgcttttcgccagcatcaccgtatccagcaccacattacgtacatgatggcgctgtaaccgttccgccacggcctcgacaatatcggtttccgccagcatcccgattttcgtggtatcaatgcgcacatcgctgaacacggaatcaagttgagcggcaacaaagtccggctctatccggtacaccgactgtacgccacaggtattttgcgccaccagcgcagtgatgaccgaacagccatatgcgcccagcgcggaaaaggtcttgagatccgcctggataccggccccgccgctgggatcggtgccggcaatcgtcagcgcgttaattcgttgcattggccgcctccacatccagatgatagagcgcatcaagaaaagccgggatgaagctacccggtccttcgctacgctctgccgcggcctgtccagccagtttcatccagcagcaggccgacgcgacattgtccagcgcggcgcccggtaacgcgcaactggcggcgacgaccgccgacaacgcgcagccggtgcctacaatgcgagtcattaacggatcgccgccgggaatgctcagcgtgcgctgaccattagtgacgtaatctatctctccggtaaccacaacgatgcagtctatctgacgcgccagcgcctgcgccgcaggcagtgcggccaacgccgcctcggtggtatctacgccacgtccgcccagcgccatgccggataacgccaggatttccgaggcgttgccgcgtattgccgccgggcgcagggacaagagatccaggcaaaatcgccgacgaaattccagcgcgcccaccgcgacaggatcaagcgtccacggcgttttggcatcataagcgctttctaccgccgcacgcatcgcgtcagcgcgtgaggcagttaatgttccgacattaatcagcaaggcgttggcgatggcggcaaacggtctggcctcgacaggatcaatcaccatggcgggtgaagcgcccagcgccagcaacgtattggcggtaaacgtttgtacgacgtcattcgtcatacagtgcgtaagcggggagagcgcgcgaaagtgttttaacgtatgcgccgcaagcgtgcggcagtgcaggtcaggctgcatggttcagctcctgcccgcgtgaagaagggacacgagcagtgtcagacttccctacgctggcattatccagatcaggtggtacgggtatttctcagccttcacaaagaagggcaccccgagtcgtcaagccccaccgtgttaagcggggtttcgctattaagcatactgtctgtgccagacaatgtaaatttacagtcagcggcggacgataatttcagcgttatcagatagttctcaaaacctattcggttctggcaaacttgctggcggatatgttgctgcacgacgctttcgtttacactttttacgaaaaggggcgtgagataacaaaatagcgcttgtcagatacgccaccagcagaaatgatacacacgatgttaactgacccgcatatgtggagggtaaaagtatgaaaagtaagttgctgccttgcgcgctgttgcttgcaaccagttttgcatgggccgcccccgcgacaacgggcattgatcaatatgagttaaaaagctttatcgccgacttcacccacttcaagcccggcgataccgttccgcaaatgtaccgcaccgatgagtataatattaaacagtggaaattacgtaatctgcccgcgccagatgccggtactcactggacctatatgggcggcgcgtatgtactgattaacgataccgatggaaaaatcatcaaagcctatgatggcgagattttttatcatcgataaaaaaagccccctcatccagagggggaaatacagccccatgttacttttttattagcccttaatcactctatccccttcaaactgccttttttgttgactgccttcactacccgattcgctctggatctcgcccttttgaaactaccgcataccacattaaaatttattgcagaaagattgtcatcccggtcacttattattgtaagtgaccggaagttcattcacctatcgcgccatatatcttaaatgtttttcatatatattaatcgtatttcacatagatcagcgcagtcgcttttagatcgcctggctttatattgtctcggtcataaacataataactggcgataatagggattgttatcatatcactgttgagcggcgtgcctacttgatccactttccataacgttgaagcattaccctgctctgctgtatttgaaatattcaccgtttttccaccgctctccagtataaatccgacgccattattcacagcaccacgcaacacagaatagctatctggtattaaatcactgctggagagataaaccgtcattttacgcgatgtttgtttagcattaccaaaaagattatcacactggagtcgaatattatccgcggcatttttgttgctgaccttgcctgtgttatataattcagaaagcgcaatattcggtagcgtgatcgtcagatcttcaggtttgcaggttgtctgcttgcgatcgtaggacacaaacagatcaaatgaatataaccctgcacctctaagataactattataatctgcggcacaggcattccaacctcttcctgctagcaggcaccctaaaaaccgcaaaccggccgtaaactgagttgcagaagaagcgcttgttattgataccaccccgttgattaggacactgttcccactaccggcagaaatatttacattcgccccagaggaagcgggttcaaccgttaccgtatagcccgttgtaaacggcattgtgagagtattattatctgcccaggcgatttttaacttcagttttactgtatcattgtataatcccacgatgatatcggaaggatccatacgcgttatcttataagtccctgaacaagttgtatcgttaaaattatggctataagttgcggactgattagggttaatcgtaaaatcctcacgaataattaaattatcctgataagtaatttctcccgtacaggctgcgtatgtttcaggtaaaatcaataacatcacgataaaaagaaagagtttcatttcaccacctcaccactaccgacaaatataaactttactttcatcaaccgttttaccaaaggtgattgaacatgaaagcccctgctctttatctactggtacactgacttcgggcggaatatcattcgttcgaataaatagctgactaccttgtccaacaatgcccacattatgaccatgatgatctactacatcataaccaaaaataagaggcgaaccatcaggacgctgcgctttaataaaccatggtttacgctggtcggtatcaaaattcactagcacgacggcccctcggtacggggcggcaactttacggttaccgcgtaattccgtttcactgctactttgcgacacatcaagcataagatggttttcgcgatatggcgtaaggttgtcataaaccaccgttccttttttattggtggtccgatatttttggccgttaacgtaggctccttcaagtcccggagcctgcataatcgcaaaggtatctgaaagccggctggataaattcaacccgccactccaggctacaaccccaccggaaatacttccgccggtctgagtataattggacgactggctgtaactaccattaagcgttgcaacgggcgtattccaggttaaattcgtccccgcagtggtctcactatcgtgtcgctgatgactaacactcacgccgtaattaaattgatcgcgactgcctgccgtaccggttaaaccaatattgtttgaggtaaatccatcatcatcaaaggtcgtcgagttcgacacattcagatgacgccgcggggtagtaataccgtccccccagtcaaagggaattgaaataaacaggttaaaacgtttatcttcattatgatcctcgtcgtaagtctgactggcggataacgtataattaattttctggaacgtattggaatagcttatttgataatctttactggtgccgctacgtccccagtaatcacgccataatgcactcagtgatactgcgccccatccttctggcaaggattggctcacattagctgaaaacgtatttttacgcccaaaatcgttttgataataatcagcaatatcgtatacatcattcttatcgcgacgatagttatttttattattggcccagacatgatcgttaaatgtgcggtaatcctgtgatgaataccgatacgcagccagaccaaaccgagttaatgtttgggtcaggtatttattataagcaatctgataactctgaccatcaaatacatcgccattatcctgtttactgtgcgctcgcgtagcgtcaagcgaaatggcgccaatccgggtattccaccccgtgccgagggtaaacgcattataatggttcgatagcatcgtaccgccataaagcgtcaacaggttattaaggccatactgataactgatttgtgtaaaatcggcctgattatcggcgccttcaatatgactacggccggcggaaaaatcatacttagagacgccaggctgcaacatgttcggtacggaagcgtaaggcaccagccaggtatttatcgaaccatccgcctcacgcacggtgacatcaagatccgcgccaccgcccgcgagttgcagatccgcaatggaaaaggggccaggaggaacctctttctgataaacaacgaatccgttctgttcgatggttaccaaagcgttagtctgtgcaatcccctgcaccaacggcgtaaaattctgtttcgagtttggcaacatttgcatatcgcgaaacaggcgaacgccggtaaatctcacagaatcaaaaatctctgacgaggtatactgatccccggcgcgtaatgtgccgaggagctcagcgataccgcgctccagatacaatgtgttgcttttccactcaccgctgctgccatcggttttattaaatgtggtatccgcatgcgcttgccagcccaacagattgaaaccgctattgaaccgaacgtaagtactttcactactgccagaattcttatagtcactgtaatactggctggcatagtaagaagtataaaatgcattgatgccgcgatcccagttttcaggcaatacataacccgcctcgacctcatttacataggcctggggaacgctcaaatccagccgaaaaacgccaatattaaaagtatagccaccgcttctcacgacatcttttaacgcaatacaatccgttgctccctgcggttgcagaccatcgcttatcacaccaatatttttcaacaactcagttgaaatacacgtgctaccgggatcatcggcaacaatgatatcgtatttacctcgccattgattgttgacataaatatccaattcgtactgtcccggaattggcttattctcatccagatggaaatttgttattttttgatctctcattccccccaccataaaatgggtatcaaacgtttccgtcgcgatagcctgcgtttgccaggtaaacagagtcaataaaacaagcgaagcgatgggcgtcatccttagcatgatgaactcctgtttattttacattcattttgctactaatatagttaccattatcatcaataatcgttacttcatactggcttgttgacgcatatttcatgttaatattttgcgtcgatagcggtggcagcatgatagtttgatcattaatcttagtatttcctgcttttacatccgtcacggtaatccagtttgcagtatcatttttcatgatgacagctttattactgcgaaataaaccaatcctctgaaaactgtctttggttacggcggcaattcgactggggcgccatattaattttattcgattctgcattgcgaatttaagcacatttttaccggcgttttcctggctgtttggtggaatatcaagcacattcagataaaacagactttctttgttgtccggtaagctattaggcattttcttgattttgatctgctgaccagactcagcggcaacgcgcgccactggcggcgtcagcataaatggcacctgaattttttctggcggtaatgaagtgttaccgtcatcaatccaggactgtaccagcgaagcttgctcgccctgattcaccaattgtacaacgacttctttcttctctgccgggtaaatcacacgcgtaccataaataacaataccagcatgcgcaggcaaaattatggcagataataatactgcagataatattttcatatttacacggccttgcttataaaaaaccggcgacgaacgccgccggttgaataaattagtcagtaacaaccgttaaagtcagtgttgagctaacatcaccagaagcaacatcaccgtctaaacgcgcatagcgtgctaaaaaagtcaggtcgtattcaccgctgctatttggatctagtgtcacccccgtctctggatcaatctgattatccgtacttccgtagtaaaccgcaaaaccgacacctttggcagacccgttattaaatgtgatatcgtggctgtcaaattgcgttgaagagaaggtaatacgcggcgctacaccctgttgacattttattttcaacggcatctgagtttgattagttactgcgtcataaatctgacccggggttaaattaattattttatccgcaccaatttcattcagtctaatttcagcggtgttcgtacccaaaaattgacaggtagtaccaaccacctttccgttaatattcagaacgcctgaatcatactcatcaacagcaaaagccccagcgctcataaatacagcagacaatacagaagcagcaataagtgaacgtttcataatctcttccttaatgaagtaatttctatttgttaagagttattaacccttgcaacgaaaattctcatagacaggaagttatcgcaatgtaaacacgatgttttgttgatttaaaacaatttacagattgcaatataattgcaacaaataatcattgcttatcattattttgtaaacttattaatttccgaaatttactgcccttaaatataaacacaacaaataaaaaagcccatatcattgatatcaatgatatgggcctgcggaattaataagaattagtcgtaatgattaacaacaatctgtcgggtgctatcaccaggcaccgtgtatagctgcgttgtcacacctctcatcggcgtagcggcgggtgtttgcagagttgaaacgtggatagtgttgccgcaacgctgctgcaactgtgcgtttaccacttctgtactgcacgttggcgcggtcacttttccactgatggttaatgttgcggtgtcggaggcaaaaacaggtacgcttatcccataagccgaaactataattcccatcagcaaatattttttcatagtgagtaattgttcctctggtgaacgtcaaacagtatgcaggccgtcctgatgagcagtatgaacgtatcgataccttaaaaccaattgaaaaaataaatcagtaggataggtatgatcaattcaaataatgtttttgccgattatttcagataaacacctgtctgtttaagcaggaattaacaatgcgggggctattattttattaatacattcactgcatcaatatatattaatgcagtgaatgtcatattctctttggaatacgtcaggaggattacaccgcgcggaaggcgatttctcccggaatcacttcaccctgccagtaaagctgtgccgcaacgcgatcggccagttcgcgatagatcgcggtaaattcgctctccggacggctaaccaccgtcggcgtaccgcgatcaagatcttcgcgcagactaatatgcagcggcatctgacccagaagctgagtatggtatttttccgccagcttctgcgcgccgcccgtgccgaagatcggttcgtgatggccgcagttgctacaaatatgcatactcatattttccacaatgccgagcaccggcacttccaccttctcgaacatcacgataccttttttggcgtcgattagcgcgatatcctgcggcgtagtcaccaccaccgcgccggtaacaggaatgttctgcgccagcgttagctgaatatccccggttcccggcggcatatccagtaccagataatccagatccggccacagcgtctcctgcaacatctgcatcagcgccttactggccattgggccgcgccataccatcgcgttatcgtcagtcaccagatagccgatcgagttggtcgccaggccgtgagacataatcggcgccatatgcgtaccgtctggcgatgttgggcgctgatcttctgcgccaagcatggttgggatcgacggaccgtaaatatcggcatcgagaaccccgacctttgcgccttcagccgctaacgccagcgccaggtttaccgccgtggacgatttccccaccccgcctttaccggagctcacggcaatgatgtttttcacgccattaatgccaggctgatttttgacgcgtttcagcgtcgcaatgttgtacgacagtttccagtcgatcgcttttgcgcccgtaatacgtaacagatcggcgctgcattgctcttttaatacctcaaacgcgctgttccagacgaacggcatgaccagctcaacgtgcagcgtatcatccatccaggcgacgtggtgcaacgccttaagcgtggtgaggttatgcttcagggttgggtgctgaaaattcgccagcgtcccggcgaccatcgctcgcagggtatctggtgatttggcctgggattgttcgttcatcccgactccttttgtagttctgaaaagtacgattgtaactttgtagtttactccagcggtaacaattattcatttacggataaatgcccttatcgattggcgcagtaattaccattttggtactatcaaagcccttttttacaacagaagaagtaatacccactatgactcaagtcgcgaagaaaattctggtaacgtgcgcgctgccgtacgccaacggctctatccacctcggccatatgctggagcacatccaggctgatgtctgggtccgttaccagcgaatgcgcggccatgaggttaacttcatctgtgccgatgacgctcatggcacgccgatcatgctgaaagcgcagcagcttggtattacgccggagcaaatgatcggtgaaatgagccaggagcaccagaccgatttcgccggttttaatattagctacgacaactaccactcaacgcacagcgacgagaatcgcgagctgtccgagctgatttatacgcgcctgaaagagaacggttttattaagaaccgcaccatctctcaactctacgatccggaaaaaggcatgttcctgccggaccgatttgtgaaaggcacctgcccgaaatgtaaatccgcagaccagtacggcgataactgtgaagtgtgcggcgcgacctacagcccgaccgaacttatcgaaccgaaatccgtggtgtccggcgcgacgccggtaatgcgtgactccgagcactttttctttgacctgccgtcattcagcgaaatgttgcaggcgtggacccgcagcggcgcgctgcaggagcaggtggcgaacaaaatgcaggagtggtttgaatccggcctgcaacagtgggacatttcccgcgacgcgccgtattttggtttcgaaatcccgaacgcgccgggcaaatatttctacgtctggctggacgcgccgattggctatatgggctccttcaaaaatctgtgcgataagcgcggtgacacgaccagttttgatgagtactggaaaaaagactccgatgccgagctgtaccactttatcggcaaagacatcgtctatttccacagcctgttctggcctgccatgctggaaggcagccacttccgtaagccgaccaacctgttcgttcacggttacgtgacggtgaacggcgcgaagatgtctaagtctcgcggcacctttattaaggccagcacctggctgaaacactttgacgccgacagcctgcgctactactacaccgcgaagctttcttcacgcattgatgacatcgacctgaacctggaagactttgtccagcgcgtcaatgccgatatcgtcaataaagtagtcaacctggcctcgcgtaacgccggttttatcaataagcgtttcgacggcgtgctggcggctgaactggccgatccgcaattgtataaaacctttactgacgccgctgcggtgattggcgaagcatgggaaagccgtgaattcggtaaagctatccgtgagattatggcgctggccgacatcgctaaccgttatgttgacgagcaagcgccgtgggtggtggctaaacaagaaggccgcgacgcggacctgcaggccatttgctcaatgggcatcaacctgttccgcgtgctgatgacgtatctgaaaccggtactgccgacgctttctgaacgcgttgaagccttcctgaacagtgagttgaactgggatgccatcgaacagccgctgctcggtcacaaggtcaacacctttaaggcgctctacaatcgcatcgacatgaagcaagttgaagcgctggttgaatcgtctaaagaagaggtgaaagccgcagccgcgccggttaccggcccgttagccgacttcccgattcaggaaaccatcacctttgacgatttcgccaaaattgacctgcgcgtagcattgattgaaaatgctgagttcgtagatggttctgacaaattgctgcgtctgacgctggatctgggcggcgagaagcgtaacgtcttctccggcattcgttccgcctacccggacccgcaggcgctgattggccgccagacggtaatggtcgccaacctcgcgccgcgcaaaatgcgctttggcgtctccgagggaatggtgatggccgcaggacctggcgggaaagatatcttcctgttaagccctgatgacggcgcgaagcctggccaacaggtgaaataagcaacaagccggagcatgctccggcttttttaaccgcttaatcctgactggcatatcaccccatccgcgtgttttaactttttccttaataagcaatagcgttaagactccatatccggactgctaaataacggctaaaagtcatattctatctctccctgatacattgctattactgggttaaattaattcattgaaattattttaaaaacccaatcattatataaaatggagttttagatgaaaatttctggcaagttattgtccgcggctttggcttccgtactggtgttctctcttgctggctgtggcgataaagaagaatcaaagacctttaacgcaaacctggcggggacagaaatttcaattacttacacctataaaggtgacaaaatcattaagcagacgtctgaaagtaaaatcagctatgccactgtaggcgctaaaacgaaagaagatgccgccaaaattctcgatccgctgagcgcgaaatataaaaatatcgccggagtggaagaaaaattaacctatgaagatacctatgcccaggaaaacgtctctgtggatatggaaaaagtggactttaaagcgttacagcaaatctcagggacgatggtgtccggcgataccagcaaaggtatcagcatgaaacaaacccagacgctgctggaagctgctggttttaaagaagcgaaataactggcaggcataatgtattgcatcgactggtaaagtcgctcagggcgctgcttcggcagcgtcttttctttatgaattccgaaaaaagacagcctcgctgtaagtcccctcgccaaagcctataatccctgaattcttggccacaccaatacttaacgacaaggaattgttatgcaggttctacgtcttatggcactgccactattcgcgctctctctatcggttagcataactggctgcgatcagaaaaacgatactctccagggaaagcaaaataacatgacagcgtttatcaagaagatagccgctagcaaagagtcagaggaaacacaacgctatgtaggtaatctcaacggtattgaaatcaagttaacctattactacaaaggggatatcgttttacgtcaaatatctgaacataaactactttataagaccctgaaagccaataataaagaagaagcacaaaaaatgctgagtcaagtcggcgaagcttatcagggtatgccgggtttgactgaacgaatcgactattatgatagctatgctacggaatatgtggatattaattttacccaggcaaaaataagcgacctctgtaaattgccaggatcatcaattgacaactgttccgcgtactatctgtcaatgattcgctcgcagaaactgctggaagagagcggatatcatagaatcaattagtataataatgcgttttcccggtcagacaggacgctgccgggaacaataccgcagaattacttcgccgcgtgttcacgggctgccagaccgcgcagaaaataacgcataaactgatcgccgcattcgcggaagttcttatggtccggcgcgcgcatcatcgcggtgatctctggcattgagacacgaaacaactgaccggtaagtatcgccaggatatcatctgtttttagcgaaaaggcgatacgcagctttttcagcacaatattgttgttgatacgacgttccgccgtcaatgcaggcgccgcctcatctttgccgcgtttttcataaatgaggccattgagaaatgaggacaacacgatatccgggcaacgctgaaacccctcttcctcttctttgcgcaaccagattgcaatctgctccggcgtagcatcaacgttacccagcgccaggatacgcgccagatcggtattattagcttttaaaatgtagcgcacgctacgcagaatatcgttactcagcatgaggccttcggtcgtttctatggcaaaacgatattctaacagtcttttacaggccaatcgcctcttttaaacttttcagatagcgacggcttaccggcaccgtcaggccgttgcgtaaaatcagctctgcctgcccattatcctccagccgtatttcctgcaaatgggccatattcaccagaaactgacgatgacaacgcagtagcggcgtccggctttccagcgtgcgcagcgtcagctcggtaaacccctctttcccttcactgctggtcacataaacgccgctcatacggctactgacaaaggcgacatcatccatttgcaacaaatagatccggctgtgtccggtacagggaatgaatttaagcgcctgctggttttccggcaacaacgaaacatcctgtttactgcgctcctgacgcagacgatgtaacgttttttccagccgtttctcctctatcggcttgagcagataatcaaaagcgtgttcttcaaaggctttgatggcgtattcgtcaaacgcggttaaaaaaacgatatacgggcggtgttccggatcaagcattcctaccatctccagtccactgatacgcggcatctgaatatccagaaacagcacatcaggtcgcaacttatgtaccgcgccaatcgcttctaccgcgttcgcgcactctcccacaatctcaatgtcatcctgcccctggagcaaaatccgcagattttcccgcgctaacggctcatcatccacaatcagcactttaatcatgcgtcctcctccagtggaagtcgtaatgtaattcgggtaaaacagtccggctcgcaggccacgctaataccataatcatcgccaaagtgttcgcgcagacgtttatcaaccagactcatccccagcccgctactgccggcggaaggctgatacagtcccgcattatcctcaatatctaacatcaaatgctgcccttcgcgccgggcgcgaatagcgacgttgccggtatcaagcagttgcgacgtgccatgtttaatggcgttctcaacaatcggctgtaatgtaaacgcaggcaatttctgacgtgaaagcgtcgatggaacatcaagctgtacctgcagacgcgactgaaaacgcgctttttcaatttgcagataagcgtttacgtgttcaatttcatccgccagcgtgacgatttccgacgggcgttttaaatttttgcgaaaaaaggtcgacaagtactgcaccagttggctggcctgttcgctgtcgcggcgaatcaccgctttaatggtattgagcgcgttaaacagaaaatgcgggttcacctgcgcgtgcaacagcttgatctctgactgcgtcagcaacgccttctgccgttcatactgcccggccaggatctgcgcggataaaagctgcgcaataccctctcccagggtgcggttaattgagctgaacagtcggtttttcgcttcgtacaatttaatggtgcccatgactcgctgattttcgccacgcagcgggatcaccagcgtcgaaccgagtttacactgcgggtgtagcgaacagcgatacggcacttcgttgccatcggcataaaccacctctccggtttcaattgctttcagcgtataacctgatgaaatgggtttgcccggtagatggtgatcgtcgccaataccagtaaaagccagcagtttttcgcgatcggtgatggcgacggcgccaatatccagctcctgatataacacctgcgccaccttcatactgttcacttcgttaaatccctgacgcagaatcccctccgttgacgcggcgaccttcagcgcggtagcagaaaatgccgaagtatatttttcgaacatggcgcgcttatcgagcaaaatacgcatgaacagcgcggcgccaacggtattcgtcaccatcatcggcgcggcaatattactgaccagatgcaaggcatcgtcaaacggcctggctatcagtaaaatgatcagcatctgcaccagttcggcaatacacgtaattgctcccgccgtcagcgggctaaacactttgtccgggcgtccgcgacgtatgagaacgctgtgtaccaacccgcccaacagcccttcgacgatggtggaaatcatacagctcagcgccgtcatgccgcccatagaataccgatgtaacccaccggtcagaccgaccagcccgccgacgaccggcccgccgagtaggccgcccatcaccgcgccaattgcgcgggtattggcaatcgaatcttcgatatgcagcccaaaataagtgcccatgatgcagaagatagaaaacgtgacgtaacacagaagcttgtgcggcagacgaaccgtgacctgcataagcgggatgaacaggcgcgttttactcattagccacgcaatgaccagaaacacgcacatctgctgaagcagcagcaacaccagattaaactcgtacatacccgcaaaccacacttcaattaaaagcgcgtaacatacattgagtacgattaactttctttgaactgttgcataaaaatatgaattcgtgaatacgatcacttaaacgccgcgccgcaacccgctacttcgcgttttaatgcataaaaaacaggcaaaacttcctggttcctaaaagagcgtctaaagttaaaccgggacctcgcgagcaagggtgaaacgatggcgctttacacaattggtgaagtggctttgctttgtgatatcaatcctgtcacgttgcgcgcgtggcagagacgttatggacttttaaaaccacagcgaacggatggcggtcatcgtctgtttaacgatgccgatatcgacagaatccgcgaaatcaagcgctggatagataacggcgtccaggtcagcaaagtcaaagtgctgctcagtagcgacagtagcgaacaacctaacggctggcgcgaacagcaggagatcctgctgcactacctgcaaagcagtaatctgcacagtttacggttatgggtcaaagaacgcggtcaggattatcctgcccaaacattgaccactaacctgttcgtcccactgcggcgacgattacagtgccaacaacccgcccttcaggcgctgctcggcattcttgacggtatcctgatcaactatattgcgctctgcctggcgtctgcgcgtaagaaacagggaaaagatgcgttggtgatcggctggaatatccatgataccacccgcctgtggctggaaggttgggtcgccagccaacagggatggcgaatcgacgtgctggcgcattcgcttagccagttccgcccggaactgtttgacggcaagacgttactggtatggtgcggagaaaaccagacgctggcgcagcagcagcaactcctggcatggcgcgcccagggacgcgacattcatccccttggcgtttaaacagaagctaacaaattcgctttaatgtatactccttttattaacataaggagtacataatgcgcgtagcgaaaatcggggtgatcgcccttttcctgctgatggctattggcggtatcggcggcgtgatgctggcaggttacagttttattttgcgtgccgggtaagcacgcgcgtcagcctttcaaacaggcgatcgataatgatcgccgccagcgccaccagcagcgccccctggataacataggccgtattaaagccgctaagcccgataatgatcggcgtgcctaacgtactggcccccaccgttgaagcgatggtcgccgtaccaatattgataatcaccgaggttcggatgcccgccagaatcaccggcgcggccagcggcagctcaacctgatacaactgttggcgacggctcattcccataccgctggcaacgctcatcacgctggcaggcaccgcgcccagcccggccagggtcgcctgcaggatgggcaacaccccatacaggatcaaggcgataatggccggttgctgaccaaaacccatgacgggtaccgcgatcgccagtaccgcgaccgggggaaaggtctgcccgacggcggcgatagtctccaccaggggacgaaactctttcccactttctcgcgtgaccgcaatccctgcgccgacgcccaccacgacggcaaacaaacttgagatgcccaccaaccagaaatgggcgagcgcgagggcggcaaaactctcctgttggtagaccgggcgcggtaaatcgggaaacagcgcggcgaagaacggctggctataaggcaatccaaacagcagaagcaagaacagaacaataagccagagaagcggatcacacagtcgtttcacggggggacgtctccgaaagcagatcgcggaaatggagcgtaccgcagggctcgccctgctgattcgccaccggcaggacgtcgcaccgacgggcgacaaacatcgatagcgcatcgcgtagcgtcatctcttccaccagcgcgtcgccgctgagctgttcatgccgacgtacataatcgcctacgctacgtaacgaaagcagccttacgcccagctcgctgcggccaaaaaatgcctgcacgaaatcattttccggcgaggtcagcatagaaagcggcgatccctgttggataacgtggcccccgtccatcagcaccagatggtcggcgaggcgtagcgcctcgtcgatgtcgtgcgtcaccagtacgatggtgcgccccagcagctgatgaatgcgggtcatctcctgctgcaatgcgccgcgcgttaccggatcaagcgcgccgaaaggctcgtccatcagcaatacctgcggatcggcagccagcgcccgcgcaacgccgacccgctgctgttgcccgccggaaagctgatgcggatagcgatcgcgcagcgcgctttccagacccaataatgccatcagttcatcaatacgatcgttaatccgcgcacgcgaccacttttgtagttgcggtacggtggcgatattttgcgccaccgtccagtggggaaaaaggccgatagactgaatggcatagcccatgcgacggcgcagttcaagcaccggcaggctgcggatctcttccccggcaaaacggatcgttccgctatcatgctctaccagccggttaatcatcttcagagtggtcgattttcccgagccggaggtgccaattaacaccgaaaagctgccttcgctaaaatgcaaattgaggtcgctaacagcctgttgatcgccgaaggttttactgacatggttaaattcaatcatcggttgctcccttcagaaacgcgatccataaatcaaacagcgcgtcgatcactaccgccaacgcaatcaccggaatgacgcccaacaggactaaatcaatggcgctgctcaatagcccctgaaacaccagcgcgccgaaacctcccgcgccaatcagcgcggcgacgacggccattcccactgtctggaccattactacccgcaggctacgtaaaaagaccggcagcgccagcggcagttgcacatgcctgaagcgctggccgctactcattcccatggctcttgcgctctccagcacatcgcgcggcacctgattgagcccggcgaccacgccgcgcaccagcggcaataacgcatagagcaccagagctatcagcgcaggcgtcatgccggttcccgcgacgccgaatgcggcaagccacggaaactgtttcaccagcccggccaacggcgcgatcagcaggccaaacagcgcgacggaagggatagtctggatcacattcagtacggtaaacaccggcccctggcgcgaggcggaaaaataacaccagacgcccaacggtaatccgatcgccagcgccggcagcaccgtgcccgccagtaacatcaaatgttgcaccagcgcggcatcgaaaacatcctggcggttggtatactctttcagaagcgagaggttgtcgaacgtgcctgaaaacagcagcgccagcgggacaatgacaatttgcgcgtgcagcaaccagcgccacagcggcccagtggtaatacggcggatcgcatcgctacaggccagcaacatcagaccgaggcccagccacaatccacttcccagactggtacgcgccagcgggctgccctcctgcgccaactgggtcgccgccctgccgactccccacagcatgacaataaaaagcgtctgcgccatcatcagcgtcagtacgctaccgcgtttaccgggtacaaagcacagcgtaaacagcgcgcatcccgcgccagtcagcatccagatggtcgccggccagatctcccataactggcgcccctcgccgctcaccagacgattcggggcgtaattaatgaaaggcagcgcgacagcaagcaaggtcagaacaaccaacagcaacagcacacgattaaccgtgatttttttggcagcatcactcacagattacttcacccaccctttttgtcggaggtaatctgcggcgacttttttcgcatccagcccttctacggcgattctggcgttcaactgttgcagcgttttctcatcaaggctggcgaaaacgggctgcagccagtcggctatctgcggataggcctgtaacaccgattcacgcactaccggcgcgggggcatagataggctggacgccttttgggtcgctcagggtttgcagacccagcgcggcgacagggccgtcggtgccatacgccatcgcggcgttaacgccggatgtttgttgcgcggcggctttgatcgtgaccgccgtatcgccgcccgccagcgacaagagctggttctgattcaaggtaaaatcataggctttttcaaatgccggcagcgcatccgcccgttcgataaattccgcagacgccgccagtttaaaagtgccgccctctttcagataacggctgagatcggcaagcgaggagagtttatttttttccgcgatgtcctgacgtatcgcgatggtccaggtgttgttggccggcgcaggcgtcaaccagaccagcttattctgctccgcatccagttttttgactttctcaaagccttgctttgcatttttccatgccggatcgttttcatctttaaaaaagaacgccccgttaccggtgtattccggatagatatccagctctccggcggtaatcgcgccacgaacgactggcgtcgtcccgagctgaattttattgaccgttttaacgccgtggctttccagtacctgcaaaatcatgttgccaagcagtgcgccttcggtatcaatctttgacccgaccgtcacgggcgatgccgcctgtagaggtaaactcaccgtcgccagcaacgccagcgaacttacccatagctttgagatcgtcatgatgctttcctcatccttttacggcctttttcagagacttgagaaaaaagcatagttgaaaagtctgcgtttaacctgggattttccgccagtttaagtgacgtggcaggcaataaaaggggggacaggaaaagtcattgccagacagggcgctgctatcgcgccctgttgacggcaggcttacagtagctcgaacgatccttgtttaacgcgagcggaatccacgccgataaagacgttgaacttgccgggttccgcgtcatatttcatctgctgattccagaacttcaacgcctcgatatcaatcgggaaactcacggttttacgttcgccgggcttgagggtgattttttcaaagccttttaattgcttcaccgggcggctcattgacgccgtgacatcctgtaagtacatctggatgaccgtagccccttcgcgtttaccggtgttcgtgacctctacgctggccgtgactttgccgtcgcgttgcattgtcggtgaggagagcgtgacgtcagacaccgtaaatgtggtgtagctcagaccgtaaccaaacggatagagcgggccattcgcttcgtcaaaataacgtgaggtgtatttgtttggcttttcaggattatacgggcgtcccgtattgagatggctgtaatagaccggaatttgtcccaccgaacgcgggaaggagatcggcagtttgcctgacgggttgtaatcgccaaacagcacatcggcaatggcgttgccgccttccgtcccggcaaaccaggtctccagaatcgcatcggcctgttgatcttcttttaccagcgccagcggtctgccgttcattaataccagtaccagcggcttaccggtggctttcagagcggtgattaagtcgcgctgactctgcggaatggtgatattggtacggctggaggcttcatgcgccatcccctgcgactcgcctaccactgcgaccaccacatcggcctgtttcgccgcctgtacggcctcatcaatcatcgcctgcggtgagcgcggatcgattttcaccgcctcttcatacaggtttaagaaatcgacgatgcctttatcattagtgatattcgcccctttggcatagaggatcttcgccccgtcgccgacggcattttgaatacccgccagcaccgtcactgactgattcgcgaccccagcagcagaccagcttcccattacatcacgttgactgtcggccagcggcccaacaacggcaatggtgcccgattttttcagcggcagcgtttccagccggtttttcagcagtaccacactttcccgcgccacttcccgtgcctctttacgatgcaggcggctttcggcattggtgtccaccgggtcgctctctttcggccccagatggctataggggtcgttaaacaatcccatgtcatattttacgttgagcacatggcgcgtcgcgtcgtccagttccgccatcgtcactttgcccgacttaatcagacccggcagatatttgctgtaatactcatccgccatgctcatatccacccctgcctttagcgccacgcgcaccgcatcttccgggtcggccgcggtaccgtgtttaatcagttctttaatagcgccgtggtcggaaacggtaattcccttaaagccccactcatcgcgcaggacatctttcaatagccaggaatctgacgtcgcaggcgtgccgttcagcgagttcagcgccaccatcaccgcgccgctccccgcatccagccccgctttgtacggcggcatgtagtcattaaacagacgctgggaactcatatccacggtgttgtattctttaccgccttcaacggcgccataggcggcaaaatgtttcacgctggtcatcaccgaatagcggtccgccgggcttttgccctgcatcgctttcaccatggtttcgcccatgatagaggttaaatatgtatcttcgccaaagccttcggaggcgcgtccccaacgcggatcgcgggagacatccaccatcggcgcccaggtcatattcaggccgtcgtccgccgcttcatacgccgatacgcgtcctacggttcttaccgcatccagattaaaagaagaagccagaccgaggcttatcgggaagacggttcgctggccgtgtaccacgtcataggcaaaaaagagaggaattttcaggcggctcaacgccatcacctgatcctgcatttgacggatatcctggcgggtgacggtattgaaaatcgcccctacctgcccgtctttgatcatctcgcgaatcgcttctttcgggttatcagggccgacgctaatcagacgtaactgaccaattttttcatcaacagtcattttcttgagtaaatccgtgacgaacgcgtcgcgcgcttcgggcgtcagcgggtgattgccaaacaggttttccgccaatgctggctgcatcgccagactcacagcaacacctactgaacataaccatttcatgttgagtctctctttatctttatcccgacgaggcggtaaaaacagaataaaaaccgcagtttgccataagcctaaacgcgagaggagaagaaagcgaaggttattctcctaattttccgcacagtcgaatacacaaccgccagcaaatggtatcaaggcggcaaatgaataccaccaacacagaaacaatttgaatgagaaagcgtattgtcatacaaagcgctatgcttaacgctgatattttgtcccaccacaaggagtggagaatgtcttccataacaatgactgataataaaacgttcctgaatgagctggcccgcctggtaggccattctcacctgctgacagaccccgccaaaaccgcccgctatcgcaagggtttccgttccggtcagggcgacgcgctggccgttgttttcccgggttcattactggaactgtggcgtgtgctcaacgcctgcgttaacgctgacaaaattattctgatgcaggccgccaacaccggtctgacggaaggctccacgccgaacggcaacgactacgatcgcgatattgtgattatcagcacccagcggctggataagctgcacttactggataacggccaacaggttctggcctggcccggtacgacgctctatgcgctggaaaaagcgcttaaaccgctgggccgtgaaccgcactcggtgattggttcgtcgtgtatcggcgcgtcggtcatcggcggtatctgtaataactccggcggctcgctggtgcagcgcggcccggcctataccgagatgtcgctctttgcccgtattgacgaccaaggcaaactgcaactggtcaatcatctgggtatcgatcttgggcatacgccggagcagatcctgagcaagctggatgatgaacggattaaagatgaggatgtgcgtcacgatggtcgtcatgcgcacgatcacgactacgtgacgcgggtacgagatatcaacgccgatacgcccgcccgctataacgccgacccggaccgtttgtttgaatcttccggctgcgccggaaaactggcggtttttgccgttcgccttgatacctttgcagcggaaaaaaatcagcaggttttttatatcggcaccaatcagcccgcggtactgactgaaatccgtcggcatattctggcgaacttcgacaatctgccagtggcgggagaatatatgcatcgcgatatctacgatattgcggagcagtacggtaaagatacctttctgatgatcgataaactcggcaccgacaagatgccattctttttcacgctaaaaggccgaaccgatgcgatgctggaaaaagtaaaatttttccgtccgcatttcaccgaccgcgcgatgcagaaattcggccatctgtttcccagccatctgccgccgcgaatgaaaaactggcgcgataaatatgagcatcatctgctgttaaaaatggcgggagacggcgtcgcagaagcgcaacgctggctgaatgaattttttaaatccgctgagggcggtttcttcacctgtacgccggaagaaggcagcaaagccttcctgcaccgcttcgccgctgctggcgcagcgattcgttatcaggccgtacacgctgatgaagtggaagatatcctggcgctggatatcgccctgcgccgcaacgataccgactggttcgagcatctgccgccggaaatcgacagccaactggtacataaactctattacggtcactttatgtgccacgtttttcatcaggactatatcgtgaagaaaggcgtcgacgtccatgcgctgaaagcgcaaatgctcgagttgttgcaggcgcgcggggcacaatacccggcggagcacaacgttggacatctgtataaagcgccggaaacgctgacgcgtttttatcggcaaaatgacccgaccaacagtatgaaccccggtatcggcaaaacgagtaagcggaaattctggcaggaaaatacgcccgacgaaacgcattaacaccgtgcggtttaccgtgaagcccggcggcgcgatgcctgccgggcctgcggcgacttaatcgttctgtgcggtttgcgctccggcactggcgctggctgccgccatttgcgcggctttttgctttttatagctcagcgcggcagccggaacgggcatgactttaccggtttcaatccatgtacgcaggcggctggcgtccgcaaagtgggtatatttgccgaacgcgtccatgaccaccagcgcgaccggtttgttattgatcacggtacgcatcaccaggcaatgccccgccgcattggtaaatccggttttcgttaactggatattccagttatcacggtagaccaaatggttggtattgcgaaacggcagcgtatacgccggatgcgagaatgtcgccatgtcttcgcgcgtggtgcttagctggccaatcagcgggtattgcttcgtggcaatcagcaattttgttaaatcccgcgcggtcgagacgttatgaatcgacagccccgtaggctcaacgaagcgggtatgcgtcatgcccagcgctttcgccttcgcattcatcgctttaataaatgcgttataaccgccaggataatagtgcgccaggcttgccgccgcacggttttcggatgacatcaacgccagcagcaacatatttttgcggctaatttcgctgttcaggcgcacgcgggagtaaacccctttcatttccggcgtctggctgatatcgaccttcagtatttcatccagcggcaatcgcgcgtcgagcacgaccatcgctgtcattaatttggttatcgaggcaatcggacgcaccagatccgggtggttcgaatagatcactttattggtgttgagatcaacaatcattgcgctaccggaggcaatctcaggttgagacgccgcggttgtcgctgccgttttcgccacagcctgcggggcaaaaggtacggccaacatcagagcaaggctcaggaatgaagctcggaatttcagcatgatgagatttctgataatgattcacgcgcgtcgtaacgcacaccgcctgagctaagattatactcaagctagcagtggcatcatagcggcacgccagcgttgccgctacagaagaatcgtcagcaaatgctgcattgctggcttttgcgccagccctttttctcatcagaacaggcggtagccgtatccccacaggatcacggtgatcgccagtagcacctccaggaccagcacgccgatagcgagcgtcgaactggagaagcttaatccttcctctctattaatgttaaggaaagtcggaatacccaaatacagcaaatagccggtgtaaaaaagcgcgacagcgccgaccagtgcgcatagccataccaggggatagagcgccaccagaccacttaaaaacagcggcgtcgcgacatagccggcaaaaaccatacagcgcgcaagcgatggccgttgcggatagtttcgcgccatccaccagatgacgcgtcccatcaccgcgacgcccgccagcatcacgccgtagaacaagaccgccagcgcaaaagcggtaaacagcgagagttgtaacacgttgccgtcgccaaaattccagccgatttgcgtcgtgccgataaaggcgcagacgacgggaatcgccgccatcagcaaaacatggtgcgtatagtgatgcgaaacagtttcgttttcgcttttgatcacctgcatttcccgatcgggatgggaaaaaagcccccatacatggttcatactgcccccttctgctgcctcagatgccagtatgttcaagtataattcagtttctggttattttatgaacaatggcaaaatagtctccggcaaaacgtcggctttgccgcgcacgcctcttgccagggtgtatgcttaatgccggaggtggtttacgcatggatatcaacacgcttattacgcattatggctatgcggcgctggttatcggcagtatggccgaaggtgaaaccgttaccctgttggggggcgtcgcggcgcatcagggattgctcaagtttccgctggtggcggcggctgtcgcgctgggagggatgatgggcgatcagctactttatctgttaggacgatgctatggcgggaagatcctgcgtcgtttcccccgttatcatacgaagattcgtcgcgcgcagaaaatgatccaacgccatccgtatctgtttgtgatcggcacgcgttttatgtacggcttccgggtggttggcccgctgctgattggcgccagccgcctgccgcctaaaatttttctgccgctgaatattgtaggcgcgctgatctgggcgctgctgtttaccacgctgggatatcttggcggcgaggtgatcgcgccatggctgcacgacctcgatcagcatctcaggcacggggtctggctgattctggccatcgtcctggtggtgggcgtgcgctggtggctgaaaagacgcggcaaagcggaggcccgttaaacccgatggtatccggatggcataacgccgccatccggcacccggcgtttattttgcgttgaattgcggattcgccagcataaacccgccgtcgacaatcagcgactgaccggtggtgtagcttgctccttccgaacacagccaggcgacgaggctggctatttcatgcgtagaacctggtcgggcgatagggattgagggttccgatcccggctcaatgtcgctgtcatccatatcattcatcggcgtggcgatagcgcctggcgcgacggcgttgaccaaaatatgatgctcaatcagttccagcgccatggatttagtcaatccccccaacgcatgtttcgccgcggtataggcgctggcttgcggaagcggcgtatgctcatggacggaggtgatgttgataatgcgccctccctctccttgtttaatcatatgccgggcggcgatctgcgcgcagagaaacgcgccatcgacgtccacggtaaaaatttgccgccactgcgtaaacggcatatcaataaacgcggatttggtcatcgccccggcattattgaccagcacgtcaacgcgccccaggcgctgaataagatgttcaatggcctgcgcgccctcgggtaactggctcaggtcaagatgaatggtctctgcccgcacaccaaactgcgccgctttttttgccgtctcctgcgcgccgcgttcatcggaatgccaggtgataccaatatcaaaaccgttttgtgctaataacaacgcacacgctttgccaattcccgaatctgatgccgttacaattgcgactttggtcatattcctctccggatgaatcatacacagcctaagtataggaaccctgtctgaatcatccggaaaaatcaggaatgataaccgccgcccagcgcgctggtaagctgaatagaggcatccagccactggccctgcaacagcaagccgttacactgctcgcgcagtgccgggattttggcctcgctcacgcgggaacccgcaataataccggcattaaagcgcgcttgcgccagaccgaccacacgctgcgcgtcatgctcaatctgctgctgatgctgatttttctgcgccagcgtctctacctgactggcggcgcgcgccacatcattaaccgcatctaccaccgctttgttgtagttggcgatagaaaggttgctttgcgctttggcgatatcgaggttggcattcagcctgccgctgtcgaaaatcggcagcgtcagcccgccggtaatgccatattgctgtgcggaatggcggaacagatcgctcagatgtaacgcatcctgctgtaaaaaagccatcagattgatatcgggataaaacgcggccttcgcggcgtcaatgctgctcaacgaggattcaatgtaccagtgcgcggcctgtagatccgcccggcgcgccagcaacgaatagcccagttgcgacggtaactggctttcaacggcggggagactcacctgacgcagcttgagcgccgccgattgcgtattggttaacgcgctgagccgcgcttcaataaccttcattttaccgttaacgtcattcaactgctgctgggttttgctggcgtcgatatcggtctcgaccccttcaacagaagaagtaataccgtgttgatacagctcccggtttaccgccaccacgttttgctgctcatgctcgatttgcatcagcacatttttcagcgctgcctgtgtttgccactcccagtagagtcgcgccacgccgcttgccagcaattgtcgggtctgctcctgctccgcttcgcgcgctttgaccgccccgatccgcgcagtaacttcagcgcggtttttcccccataaatccagatcccagcccgccgtcaggccgaatgtaccgttggtataccacggcccggtcgttcccgccgcagggtcggtaatcgcgaatggccccatcagcccttccgcggacattcgctggcgctcaatgtcggcagaaaagtcgagctgcgggccgtcctgcgcctcaaccgctttcgcctgcgcttccgccagttgaatacgctgttcagccacctgcatatccggcgaatgctgtatggcattatcgatcagcgcgtcaagctgcgcatcgtgatacgccttccaccactggctatccggccaaccgtttttcaatgccgccggcaggctggaatcaacatgagaagagggcgtctgctgggtcagcgactggcgggtatcgtgcatgggggcgcaacccgccagcaaaataaaaagcggtaagctcgctgtcgcggcaaggaaagaattacgattcatggaggtgttctgataaaaaaaggtgcgcagagagtacgtcttacggcgatctattttttagttacgcgtggcaatacatcatcagacaacaaaagacatattttgaaatttatatgattagtaaataatttcatctgatacattttttgatgtaatacttcaatgaaaagtcccactaacccgttcataaatgaacgattttgctgcaatacgcgccagcagccttcatgagttaaacgtcgccgcgcccaacaaagcagcagatggcttaatactttcctatactttgtttgtatttaccaataaagggacaaacaatgaaaattcttctatgggcaatcttaattatttttctgattgggctgttggtggtaacgggcgtgtttaagatgattttctgattcctgcgccgggcagcgatagtatctgcccggcacacgttctggacgctgtagagattagattttaatagcctgaatcgcccgcgcaatctcggacgaacggtttaacgcccgaatcgactgaaagagttccgtcgcctcaatatattccttacgtaaatatcccagccactgtttaatacgcgcgacatgatataaaccggtatcgccctgcttttccagtcgggtatatttttgtaataacgtcaccacttccggccacggcatacgcggctcgttatacttcaccacccggctcaggttaggaatatttaacgccccacggccaatcatcaccgcatcgcagccgctggtcgccatacatgcctgcgcgctctgccagtccaagatttcgccattcgcgataaccggaatagtcagacgctggcgtatttcgccgatcgcctgccagtcgatatgctcggcgcggtagccctgcgctttggtacgaccatgcaccaccagttcactggcgccagcctgctgcaccgcatcggcgatttcaaattttctatcgccgctatcccagccgagacgcacttttaccgtcaccggaagatgcgacggtaccgcggcccgcatcgctttcgcgccctgatagatgagttcgggatctttgagcaatgtcgcgccgccgccgctgccgttcaccacttttgacggacagccgcagttcaggtccacgccatacgatcccaacgccgtcgcccgcgcggcgttttccgccagccactgcggatgctggcccagaagctgaatacgcaccggcgtgccggacggcgtgcggctggcgtgatgcaactccgggcagatgcgatgaaacacttttaccggcagcagctgatccaccacgcgcacaaattcggtgatgcagagatcgtaatcattcacttcggtcagcagctcgcgcactaacgcgtcgagcacgccttccatcggcgccagtaaaacacgcatatcggtatccacagcaaaaaaagaggcgctatcataacgcctctctgcgatgagcaaaactttttgccgggtggcggcgcaaacgccacgctacgtcacgtaaagtgctcaacgcggctcaagacagttatcttctttccagccgtacagccattcgataccgcgataaaacgcctcctgcgatttccctttccacaacagattacgcacctgacgctccaccccggcggcgtgatagagacgccccatctcgcgggtagaccagacgatacgcgccgtgcggggaatacgcaccgactcatacagcgcaaatgcctgctgcgcgtcgccgtcgcagcgttccagcgctttgcctagcgtgacggcgtcttccagcgccatacaggcgccctgggccatatattgcgccaccggatgcgcggcgtcgcccaccagagtgatacgctcggttccccattttgcgaccggctcgcgatcggcggtcgaccagcggcgccaggaggtcggcttatccagcatctggcgcgggcggggatgaatgccggcaaaataagagagcacctcttctttactgccgtctttcacgccccactcttcttgctggcggctgtggaatgtcaccaccagattgtactgttgacctccgcgtagcggataatggaccaggtgacaatgcgggcctgcccacagcaccggtgcgttaatacgtaaatcgtccggcatatcgtcgcaatcaatcaccgcccgatagactacatgccccgttacgcgcggcgcgtcgccgagtaaactttgccgcacgaccgatttaacgccgtcgcagcccacgagaatatccgccgtccagctatttccctgctcatcaaacaccgtaacgtcatccggcgtctggcggatatcgacaatatgggtcgaggtacgatactccacgccagggtgcgtcagcaccgcttcccataccgttgcatgaatatctacccggtgaattaccgcatacggcccgccaaaatggtcgcggaacgcctgtccggtttcaatgcataccacttcttcggcattcacggcatccatcatggtaatgtgatcggtaaacaccgcacgctggcgggcaacatcgcccacaccgagactatccagcgccgaaaaagcgttcggcccaagctgaatacccgcgccaatctcgccaatttcgtgcgctttttccaacagcatgacttttattccctggcgcgccagcgacagcgcggtcgccgcgccgccgattccgccacctacaataattgcgcttgtcacgtgagtcatggtcattctccttttcaggccgggattttatcttgttgattttccggcgcggcggcaataaacgccggtagctgtacgcaggcgtcataaacggctttacagcgcggatagcctgataaatcgcagcccatcctgagcgcattcgcccactgaggaatcaggcagcagtccgcaaggcctggcgcgtcgcccacgcagaatcgtccggactgacttttacgcaatagctgctctaccgcgcttaacccttgctgtatccagtgggcgtaccagcgttttttatcctcttcgctaaccttcagctcatcggtcaggtagcgcaacacgcgcatgttattgattgggtgtatatcgcaggcgatagcgtagacaatttccagcgcctggctgcgcgccgggtcgctcgtcggcagcagcggcgtttgcggaaaatgtcggtccagccagtcgacgatggccagcgattgccccaacgattcgccgtcatcagtgaccagcgtcggcaccaggcctaccggattcatccgtcggtaggccagcgcattctgctggccgatacgaatattgacgcccaccgtctggtaatcaatcccctttaacgccagcgcaatacgtacacgataagacgccgaactattaaagaaactgtacagcttcatcgttcacctcagacaattttcacagcaatcggcgtcagaccttctacgttcccggtgatgacatcccctttcaccactgcgcccaccccctctggcgtaccggtgaaaattaaatcgcctggctgcaattcaaagaagccggacaaatagctgatggtttcattcaccgaccaaatcaggtgacgaatatcgctgcgttgatggtcttcgccgttaacctgtagccaaataggggcgttatccacattatgcgtttcagcggctttgtgtaatggcgcaatgggcgcggagagatcgaacgctttgccgatttcccacgggcgtcccatctgacgcatttccatctgacgatcgcgacgcgtcatgtccagaccggtggcgtatccccagacatattcatgggctttttccagcggaatatcgctcccctttttaccaatcgccaccaccagctcaatttcataatggtagttatcggtctgcgccggatacggcagttccagggtatcccccgccgctaccgggaccacagcgtccgctggtttacaaaagaagaacggcggttcgcgatcgggatcaaagcccatttcacgggcatgggcggcatagttgcgacccacgcagtaaacgcgacgtaccggaaactgctcatcactgcccgccacgggtactgttaccggggcctgcggctggaatacatatttggtcatgttctctctccctaattaataacgtgcttcgcggaacagccccagggcttcctgaaccggcttgtccgaaaaactgaataacaccgtgtcttcgctgctgcgaaacgacacctcatgccaggtcggcgccacaaaaatgtcttttgcggaaaaatgaaaagtttcgttgccgatagtgacctgccctgccccttcaacgacgtggtagatagtgctgtcggtgctccgcgccacacgcgaggcaaagccttttggcagcagttgcaggaacgcgcccatcgacggcatcggataaccgccggtgacgggattaacgtaacgcagcttgtagccttcccactcatccggatcgcccatacgggtcagatcgtgcaacgcctcgcgactgcggtcgtaacggtagttgaaaatcggcgacgagttcccgcgctggtggcgcagcggcagcatattcgctgcatagcgcggcagataatcgccctcttttcgcgtcaccggctgctgatcttcgggatagtcttccgcaaaaccacagcccaggagattgactaacggcagatccagaccatccagccataccaccggctctgatcccggattaccatgatcgtgccagcgccactgcggcgtcaggataaaatcgccggtatgcattggcgtgcgctcgccgtccaccgcggtaaatgcgcctttaccttcgacgataaaacgcagcgccgactggttatggcgatgactcggcgcgacttcgccgggcaggatcagctgtaaaccagcgtataaggtcgccgtgatcgacgactgaccgcgcaatgccggattttccagcaccagcacccggcggatcgcctctttcgcgccaatgacattgccgctttccatcagtagcggacgaatttcctgataattccagtaggccggcgcgcagttggcgtttggcgtctgcggtaccaggtgatgtaacgattcccacagcggcgtcagattctgcccggaaatatgctggtaatactgctgacggctatcttttacgttctgatttatttcagacatggagattctccttattcgtttacgacgctggcacgcggcaggtcgtcaggtacagaaatcgaaaggcggacaaccactgtcagcagggtaagcattaccgcgctgatagccgccggaatagcaatgacaaaaaacaacgtatcgaaagagaaattgagggccatcatcatgccgccggagagcgaaccgacaatcgccccgcagcgtccaatggcgttcgaccagctcacgcccgtcgcccgactttgggtggggtacagcgtcgccgtcagagcattcagcccgacctgggaaccgctaataccgatgccggtaccaaaaatcgccagcgccatcagccaaaggccgttttcgctcaggcctatcatgacaatgcaaactgcgcccagcgcatagctcaccgccagtacccggaacgggttaagccggtccatcaacacgccgagtaacagcgcgccaagcgtgccgccaacctggaatgcggcagtcacccacgacgcctgttgcagatcaatacctcgatggttaagtaacgtcggcatccagctggaaagcagatagataatgagcaggctcataaagaacaccacccataacatcagggtaatgacaagctgtcgcccggcaaaaagctggcgaatactgcctttggcgacggctgccgtctcatgcagaaagaattgcgtatcgtgatagcgctcgccggtaatggcgctgaccgtccgggcgacaacggcttgcggtagttggcgacgtacctgccagcggggagattccggcagcgcgaacagcaggccgaaaaacagcatcaaaggcaagatgccgcctagcgccagaattccgtgccagccaatcagcggcaccagttgcgcgctcacaatcccgcccatcgccgaccccagggtaaaaccgcagaacatcagcgtgaccagcgctccgcgtcgacgagcgggaaggtattccgacgtcatggtgatggtattcggcatcgctccgcccagtcccagaccggttaagaagcgcagcaacaccagggtttctatatccggcgagaaagcggaaagcaggctcaatgcgccgaatagcgccacgcaaagctcaatgacccgcttgcggccaaagcgatccgccagcggcccgcatagcagcgcgccggccgtaagccccagcagccctgcgccaaacagcggcgcaagttcgctggcgcttagctgccagtgggtacgaatatccggggcgatgaagccaatcgcggcggtgtcgaaaccgtcgagcataaccaccagaaaacagcagatgataacgcgccactgcattttgccgacgggcgcggcatcaataagggcttgtagatcacgtcgttgagtcatagctaatgcctcagtgcagggagatagatgttgtttttatgtttgctatgttacgagtttgtagagtgagcgataaaatgtacaatggcttttcaggcagagacataacctggaggttatagcgaatggcgaactgggcgcagaaattgaaattacatcacctgcaaacgctggttgcgctgggcgaacagggcaacctgacgcacgtcgcccggatgatgaatatctcccagccggcgctatcgaagtggctatctcaactcgaagatgagataggcatcacgctttttgagcgccacagtaaaggactacgcccctcggaaggcggtaaattactgctccagcacgcccagcgcctaattaacgatctggagcgttcacagtatgaaatcgcccgtttcaagcagggcggcctggttggcagcctgaagatcggctgttcgcccgtggcgactgactgcgtatcacaggcgattctgagcctgcttaacgaaatgccgacgctgcatctgaatattgaagagaaggtaatgacgccgctgctgcacgatttgcttgccggtcaggtggatgtggtggtagggcgtgtcggcggccgcgccctgcaactgccgcttaattatcaggtactttataccgagccggtctgctttgtggcgcgtccgcaccatccgctggccgcgcgagcgcagatcgcctggagcgatctggcgcactggcggtggatagtctggccaaccggcacccctattcgcatcagtattgataacgccctcgtcgataatggcgtcatgctcccggaaaacaccattgaatcggcgtcaatgaacgtcagcaccaatttgctgcaaagcagcgatatgatctctattctttctttacggctggcgcaacgctatgccagccaggggcaactggcgattttaaacttgccaaaaattgagcaaaaaggcagcgtagggatgttctggcgtaagaatgagacgccgtctttggccctgagtcgctttttgtattttttagcccaggtttagcgccgccgaccaggggcattgcccgatgttcctgctgtctatacccactatgctaagaattcatgatgtgatcggtagcacgttttaacgtttaattgtatgatgaatccatctcatcaagggctttaaacatgagtaagtcactgaatattatctggcaatatatacgcgcttttgtattgatttatgcctgtttgtacgcaggcatttttcttgcatcactgcttcctatcactattcccggcagcattatcgggatgttaattctgtttgtattgctggcgctgcaaattctgccggcaaagtgggttaaccccggctgttatgtgctgattcgttatatggcgttgctgtttgtgccaattggcgttggggtcatgcaatattttgacttactgcgcgcgcaattcggcccggtggtggtctcttgcgctatcagtacgctggtcgtttttgtggtcgtaagctggagttcacatctgatacacggtgagcgtaaagtggttgggcagaagggaacgaaaaaatgatgacatatatctggtggtcgttaccgctgacgctggcggtatttttcgccgcccgccgactggcggcgcattttaaaatgccgttgctgaatccgctgctggtggcaatggtagtcattattccttttctgttgctgaccggtattccctacgagcactacttcaaaggcagcgaagtacttaacgatctgctgcaaccggcggtagtggcactggcctatcccctttatgaacaattgcaccagattcgcgcgcgttggaaatccattattagcatctgttttgtcggcagtctggtagcgatgattaccgggacatccgttgccttgctgatgggcgcaacgcctgaaatcgcggcatcggtactgcctaaatccgtgactacgcctatcgcgatggcggtgggcggcagcatcggcggcatccccgcgatcagcgcggtatgcgtaatttttgtcggtattctgggcgcggtgtttggccacacgctgttaaacgcgatgcacatccgtactaaggccgcacgcgggctggcaatggggaccgcctcacatgcgctcggtactgcgcgctgtgccgagctggattaccaggaaggcgcgtttagctccctggcgctggtgatctgcggcattattacctcgctggtagcgccctttttgtttccgctcattctggcggtaatgcgctaacgacgggacaaaagaccgggttaaaatttgcgatacgtcgcgcatttttcattgaagtttcacaagttgcataagcaatgagatttagatcacatattaagacatagcaggcccgtaaactacggttccattacattgttatgaggcaacgccatgcatccacgttttcaaactgcttttgcccagcttgcggataatttgcaatcagcgctggcccctatcctggcggaccaccattttcccgccatgctgaccgcagagcaggtctcgacgcttaaaaatacggcgggactggacgaagacgcgctggctttcgcactgttacctctggcggcggcctgcgcccgtaccgatttgtcccattttaacgtcggcgcgattgcgcgcggcgttagcggcaactggtatttcggcgcgaatatggagttcctgggcgccaccatgcaacaaactgtgcatgctgaacaaagcgcgattagccacgcctggctacgcggcgaaaaagggctcgccgccgtcaccgttaactacacgccttgcggccactgtcgccagtttatgaacgagctgaacagcggtctggatctgcgcattcatctgccgggccgcgcgccgcatacgttacgcgattatctgcctgacgctttcgggccaaaagatctggagatcaaaacgctgctgatggacgagcaggatcatggctttacgttaacgggcgatacgctaacgcaagcggcgattacggcagccaataagagccatatgccttatagccactcaccgagcggcgtggcgctggaatgtaaagatggccgtattttcaccggcagctatgcggaaaacgccgcctttaaccctacgcttcccccgctgcaaggcgcgctaaacctgctgagtctcaatggctatgactatgcggatattcagcgcgcgattctggcggaaaaaggcgatgcagcattaattcaatgggatgccaccgccgcaacgctgaaagcgttaggttgccataatattgaccgcgtgcttctcggctaagcaaatgtgccggatagcgacgcactggcgtcttatccggcctgactctcctcttccgcgacccgatacaagggaaatcatgctgaaaatctccgcaatcagacggcggtttcttgcgctacgtcttcgggtacagtagcctgatcgtactttcatcctggtatcgagtttcctgcatgttaaagcgcgtgttttacagcctgttggtcctggtaggcttgctgctgttgacggtgcttggcctcgatcggtggatgagctggaaaacagcgccctatatctatgacgagctacaggatctcccctaccgccaggttggcgtcgtgttagggacagccaaatactatcgcaagggtgtcattaatcagtactatcgttatcgtatccagggcgcgttaaacgcttacaatagcggtaaagtcaattacctgctgctcagcggcgacaatgccctgcaaagctataacgaaccgatgaccatgcgcaaagaccttatcgcggcgggcgtcgatcctgcggacattgtgcttgattacgctggcttccgtacgcttgactccattgtgcgtacccgcaaagtgtttgataccaacgactttattatcatcactcagcgcttccactgcgaacgcgccttgtttattgcgttgcatatgggcattcaggcgcagtgttacgcggtaccttcacccaaaaatatgctgacagtgcgcctgcgcgaatttggcgcccgctttagtgcgctggcggatctctatatttttaaacgcgaaccgcgttttttaggcccgctggtacctattcccacgcagcatcaggtgccgaatgacgcccaggggtatccggccgttacgccggaacaattgcttgaactggaaaagaaaaaagggaaatgatcatggatgtacagacgatatttgtcatattagcctttctgctactcccgcttttttgcttccgtgaggcctggaaaggctggcgaaccggcgcggtagataaagttgtcaaaaatgcgcgaaaaccggtttatgtctatcgccatgccgatcccgtacaatattggtcttatctttttctttataccggttgcggttttttatttactggaatgattatttatcttcttttttatcgttaatctatttattatccctttaaaattgagaatagttattattatgatataaggaacaaatgctgttttgcattctggtttcatttttttgtgaattctttcacagaatacccttctttcaatgcttaggctggcggtagattttagatcattaaaacgcgttatttgcgtttcgccttaatttattcaagcattaaggaagattatatgccgcaacaaaattatctggatgaactcacgcctggttttacgccattactggcaataaaagaggcttcacgttgtttattatgtcacgatgcgccctgtagtcaggcttgcccggcgcaaaccgatccggggaaatttattcgttctatttactttcgcaattttaaaggcgcagcggaaactatccgggaaaataatgcgcttggcgccgtctgcgccagagtctgtccgacggaaaaattatgccagcgcggatgtacacgttccgggatagataaacctattgatattgcacgcctgcaacgttttattaccgattttgaacagcagactgccatgcagatttatcagcccgggagtaaaacacgcgggaaagtcgcgattattggcgcgggtccggcaggtttgcaggcaagcgtgacgctcacgcatttaggctatgacgtcaccatttacgaaaaacagccgcagcccggcggatggctgcgtcacggcatcccggcatttcgtctgccgcaaagcgtactcgatcaggaaattgcccgcattgtagaaatgggcgtcaatattaaatgtaattgtgaggtgggcgggtcgctatcgcttgcgcaactcaaagccgaatatcgcgccgtgctgatgaccgtcgggatgtcctgtggctctggtttaccgttatttgagcaagccagtcacgtagagattgccgttgattttttacagcgcgcccgtcaggccgacggcgatattagcgttccgcgtagcgcattaattattggcggcggcgacgtagcgatggatgtcgccagtacgttaaaaattctcggctgcccttccgtcacctgcgtggcgcgggaagaattagccgaattccccgccagcgaaaaagaatttaccagcacgcaggcattaggcgtatcgattattgatggctttacgcctgtcgccgtcagcggaaataaagtgaccttccaccatgtacgccactcaggagaactgacgctggaagcggaaaatattattttggccgtggggcagcacgcgcgactggatacctttgcggagataaaagcgcagcataatattatcgacacgcataattatcaaaccgacgacccggcgatctttgccgctggcgatattgttaaaggtgataagaccgtcgtttatgcggtaaaaaccggaaaagaagccgctcaggctattcatcattatttagaggaggcctgctcatgttaacaaaagatttgtctgttaccttttgcggcgttaagtttcccaatccgttttgtctttcttcttctccggtaggcaattgttatgagatgtgcgccaaagcctatgataccggctggggcgggatcgtttttaaaaccattggtttttttattgccaacgaagtctctccacgttttgatcacctgacgaaagaagataccggttttattggcttcaaaaacatggagcaaattgctgagcatccgctggaagagaatctggccgccattcgacggctaaaacaggattatccggataaggtgctgattgcttccatcatgggagaaaatgaacagcagtggcaggaactggcgcgtctggttgaagaagccggcgcggatatgattgagtgtaacttctcttgcccgcagatgacctcgcacgccatgggaagcgatgtagggcaaagcccggaactggttgaaaaatactgccgcgccgtaaaacgcggttcatctttgccaatgctggcgaaaatgacgccgaatattggcgatatgtgcgaagtcgcgctggccgccaaacgcggcggagccgacggtatcgccaccatcaacaccgtgaaatccattactaacatcgacctgaaccgcaaaatcgggatgccggtggttaacggtaaatccagtatctccggttattcaggaaaagcggtgaaacccattgcgctgcgttttatccagcagttgcgaatgcaccctgaactgcgcgatttcccgattagcggtatcggcggcattgaaacctgggaagacgctgccgaatttctgctgctgggcgcggcgaccctacaggtgacgacaggcattatgcaatacggttatcgcattgtagaagatatggcgagcggcctcagccactatctggccgatcagggatttgcctcattacaggagatgatcgggctggcgaatggcaatattatcccggcggaagacctggatcgcagctatatcgtctatccgcggattaatcaggagaaatgcgtcggctgcggacgttgctatatctcctgctatgacggcggtcatcaggcgatggagtgggatgaacacagccgcacgccgcattgcaatacggaaaaatgcgtcggttgtctgctgtgcggtcatgtctgcccggtcgcctgtattgatttaggcgaggtcaaatttaaaaaaggcgaaaaagagcacgcgttaacactgtagctctcggtatgaagcccggcgcgcagtttcgctgcgccgggttatctgataagcaaggcaataggtctggataactacttcttacgcgcgtatttcagcgagtccagcgccacggcgaaaatgataatgccgcctttgataatgtactgccagtacgggtttaccccgatataggtcaggccgtagttgatgacggtaaagataatgacgccggtcaccacgccgaagaccgtacccactccgccgctaaacgatacgcccccgaccacgcacgcggcaatcgcatccagttcatacataaagccgaggttgttggtggcagaaccaatacgccctgcttccagtaagccgccgaaggcataaaacacgccggagagcgcataaatcatcagcaggttcagcgccacgtttacgccagaaactttcgccgcttccgggttgccgccaatagcaaaaatgtttttaccaaaacgggtcttattccacagcacccagacaaacgctaccgcaatcagagcgtaaaaggtgatgtatgagagccggaaactgcccatcgccacaaagccctgtgcaaaggtggaaaagccgctgtcaaagccggaaatgggcgaagcgccgacaaagtcatagtaaagggagttgatcccataaacgataatcatcgtgccaagcgtggtaataaacggcgtcacgttcaggtaagcaatgatgatgccgttcaccaagccaatcaccgcgccaatcgcgcagacaatcaggatgaccagcgcaatcggcatggtcgccatttccggaaacactttattggcgttttccattgattgcagtaatgttgccgccacgaccgccgccagccctacctgacgccccgccgacagatctgtcccctgggtgacgatgagtcccgccacgcccagcgcgataataatacgtaccgaagattgcgtcagaatattacttaaattcagcaaacttaaaaaagtcgggtcctggaaaataataatcgccagcaacactaaaagaacgacgtaaattccgccctctttcagccaggtcaaaaagcttttcttgtttaacgcactcataaggagcccctgatcttaaaggtgcaaagaagcaagacgcaaaatttcgttttgcgttgttgttttagtatcgacaatgccggaaacgagaccgttactcatcaccaggatacgatcggtaatccctaacagctccggcatttcagaagagataatgatgatccccttgccttttttcgccagttccgcaataagctgataaatttcaaattttgcgccgacatcaatgccgcgggtcggttcgtccagcattaatatttccggctgcgttaatagccagcgaccaatgatcaccttttgctgattgccgccggaaagcgaaccaatttgcgtgcgatgccccggcgtttttacccgcatggaatcaatgacccattgggtgtcgcttttcatccgggaattatccagtaaccccactttatttttataattacggatattcgaaattaatgagttaaatccgatatccagataggcgtaaattccggtggaacgacgctcttccgtcaccagcgcaaaaccgtggttaatcgcttcgttcgcagtgtgattattaattttcttgccatgtaaagtgattgtcccggacgacttctcacgaatgccaaacagcgtttcgacgatatcggtacgctttgccccaaccagaccggcaatgcccagaatttcgcccttgtgcaaatcaaaggagacatcgcgaatggaaggctgacgcagcgaggtcaggtgacggacctccagaatcacgtcgcccggcttattttctttatccgggaaacgctggttcagggaacgcccgaccatcatcgcaatgatcttatccatatccagcccttccagcggctgggtggcaatccactgaccgtcgcgcaaaatagtaatttcatcgcacaattgaaaaatttcttccattttatgcgagatataaacaataccgcagccgcgttctttcagcttgcgaataatcgtgaacagatgattaacctctttctcagttaacgatgaggtcggttcatccataataacgatcttagcgttataggaaaacgccttcgcaatttcgatcatctgcatttgcgaaacggataacgttcctacgcgcgcgcgtgggtcaatatcgatatccagttcatcaaatatcgctttggtatcctggtacattttatcctggtcgacaaacatacctttggtgggataacgtcccagccacatgttatccatgaccgaacgttgtaataccaggtttaactcctggtgtaccatcgaaatcccattctccagcgcttctttcgccgaatggaagtccacttcttttccctgaaatacaatgctgccggaatctttttggtaaataccgaaaagacattttaataatgttgatttgcctgcgccgttttcgcccattaatgcatgaatagagtgcggacgaacgtttaagttgacattatcaagcgctttcacgccgggaaatgatttgttaatgccacgcatttccaacaaatattcacccgacggcggagaaatcgtgctgcccataatgataccctgtcggcctttttaattatgactatccgcgccggatggcaaaagaaatacgttatccggtctgcggcgcgtcacccttccacggtttcagggcgcaacaaaattgcgcccacagacggaaaagttatttttgggtaaattcgctcagattgtctttgtccacgccgacataaggcacgcgcacgattttgttctcaatcttccagctggtgccgtcagccgcgcccttgccttcggcgaggtttttcgccagatcgaatgtcgctttcgcctgattgttggcgtcattcagtaccgtaccggccatcgcgcccgatttcaccagcgccagggcttccggtaacgcatcgacgccaaagaccggaatcgacgatttattatgcgctttcagcgcctctaccgcgcccatcgccatcgcatcgttattcgcgataaccacttcaatcttgttagcgttcgggccagacagccaggcatccatcttatcttttgcctgcgcggtatcccacatagcggtgtctaacgccagttgctcggtctgaatacctttatcatttaactctttcaccacatacgtcgtacgggcttcagcatccgggtgccccggctcgcctttcagcagaacatactgaattttaccgtctttattcagatcccaaccctgattcgcctgccagtgtttggcaatcaagtcgccctgaatcacaccggattctttagagtcagtcccgacataatacgccttgtcatagctgtccagcgctttgcgggaaggctctttgttaaagaacaccaccggcacattttgcccgcgcgctttctcaatcaccgtaccggcggctgccgggtcgaccaggttaatcgccagagctttaacccctttcgccaataaaacgtcaatttgatcattctgtttggactgatcgttttgcgagtcattcatcagtagctgaacatccggcgcggatttgccatctttttcaatagccttacgcaccacggacataaagttatcgtcatatttataaatcgtcacgccaatacgagtatcagccgcgtgcgcgtgcgcgccgaataacagacttgccatcacggcagaaagggtcagtaccttcttattcatggtagctccggttttattatgtagggtatagcgtaaaaaaatgcccggctgttcagcacgttaacgcgtgttactgaacgccgaagcgtatttagagcctatcccaccaggcgttattggcgcagccagtttggacacggacagcgcgcaaaaaccggagcgtacacgtagtacgtgaggtttgactcgctacgctcgcccttcgggccgccgctagcggcgttcaaaacgctaacgcgttttggcgagcactgcccaggtccaaaatggcaagtaaaatagccctaatgggataagctcttattcaactctttatttttgtccggtagtcgcgggatattgtgataacggtttttataagcgaaataccccagcaaaactgacaactaactgttacacgttagttacagtgcgacaaacgttgtcatcatagctatcacaatgttaataaactgtgaatttactcacagattgaaaacggttacatgcggtgcgtaatcagttagtgatcagtaccgcattctgtcgccatgccaccgaatggcgccgtaccagggtcggcataaagcagtgcgtcgccgtgatatccagcgtgcctgcggccccctgtaacgccagctcggtcgcgattttcgccatagaagcaataggatagcgcacggtagtcaactgaggatcggtataacgagcaatagggatatcatcgaaaccgatgacagacagatgcaagggaatggcgatgccgttatcttttaacgccgtcagcgcgcccgccgccatgttatcgttataggcaaataccgccgtcagttgcagattgcgtcccagcaactcaaccattgccgactcgccgccctgcatgtccggcgtgccggtgcctatccagctctccgacgcagcaatcccctgctcttgcagcgcgtgtaaccacccttctctgcgcatcgcgtcatcttcaatacggtggctggaggccaggtagccgatgcgttgatgtccattattcagcaacattcgggtcgccattctggcgccgctcacattgtcgagacaaacacaacgatgcgcataacccggcacgatacggttaatcagcaccataccggggatctgatccataaagtcgctcagctcgcgatcggttaaggcttttgagtgaacaatcaatgcgttacaacgctgacggatcaagacttcaatcgcatggcgctctttttccgcctcatgataactgttgccaatgagaacatatttctggtgctgctgcgcgaccagatctacggctttcaccagagcgccgaaaaaggcatcggaaacatccataaccacgacgccgatggtgtcgctcacctgagtggccagcgcttgcgcattcgcatttggccgatatcccagcagggtgacggcctgcataacggcgtcacgggtgtcgggactgaccaacgcgctgttattcagtacgcgggaaacggtcgctacagacacgccagcctggcgcgctacatcacgaatggtgatcatattcactgccctgtttgagttcaaaaatgctcacaaatgccccgttagcaggcggctattttgtcagcaccctgcccagggctgcgtgagaaacatcacagggatggaaacggttacagccattttgttaatgaatgtgatccagatcgttatctgagcgatcctgacgcgcgcaacgtgagttgacgccataaccactcgaccggtccctgtcgccagaaacgtagccagatgacggaaaagagaaggtttattgcccataccggaacgacaaagaacaagagttccagtcgattgaatttcataaataagccaaactgataaaacagcgtggtacagatgatcgtctgcagcagataattggtcagcgccattcgccctacgcaggcaatggcaagcgtcagtctgcatcggctaagctgcggccagaagccaaacatcagcgcggcatagcccagcgtttgcaacggcgcgctcagttcgcgcggcgcctgcaataagaaggcgcaccagcggtacgcccagtccagccgccattgtaagatgaccgcaggcaggttgatcattagccctaacgccaccagcagagccccggtacggcgatagtgccgcagactgtactgacctttcagccagccgctacgcattagcgcagcgcccagcagcatcatacccgccagttgccagccatactgcgcgccgagcgccagtaaactattcgacagcatctctgcccggttgctgatagcctccatgccgccattcagcttccagtatttttcatacaatattgccgacgcatccggcgtccaggcgcggctggtttcgctactcgataccacgcccagcagcagtagcacgccaatcccgaccagataaaggagtatgccggtattgaacaggctttttaccgaaggcgcatcgcgtatcagtcgccagcaaattaacccgaccagaccgtaggccagcagaatgtcgccgtcccaaaagaataacgcatggataaaacctaacagtaccaatagcgttaagcgcgactgaatccactgtttaccacgcggaagcagcatttgtagccccgcgccaaacaacaacgcgaacagcgtaagaaacttagcctgcgccacaatatcgagaatcgcccaggaccaggcgtcttcgggaacgatcgcgccgtaccaggcgggattgagataagccgccttcggcaatccaaaggcgctaatgttaagaagcaggataccgaggatagcgacgccacgtacaaaatccagcgtgacattacgctccatcgtctccaccttaatcatggatgatggcgaacggcacgcagaaactcctggcgcgtattctggctggacttaaacaatccgcccagcgacgtcgtcgtcgtggcgctggttgcgtcacgaataccgcgcgctttcacgcagtaatgcaccgcatcaatcgataccgctacattattggtgccgagcaaggtttgcagcgccgtcagaatttgttgggtcaaacgttcctgaacctgcggacgctgggcgaagaattgcacgatgcggttaattttcgacaggccgatcacggaatctttggggatatacgcgacggtcgctttgccatcaatggtcacgaagtgatgttcacaggtgctggtcagcgtgatatcgcggacggtgaccatttcatccaccttcattttattttcaatgagggtaattttcgggaaattggcatagtcgaggccggcgaaaatctcgtcaacgtacatcttagcgatacgatgcggcgtttccatcagactgtcatcgctcaaatcgagattcagcaactgcataatctcagtcatatgccctgcgataaggctttttcgcgtttcattatccagttcatccataggcgggcgcagcggcgtttccagcccccgggcaaccagcgcgtcatgaaccagggccgcttctttactgagtgatggcattaatcgtgttctcctgcaggtgtggcgcctctgccctgcatggggcaaagtttgtcaatattgtgacagtgtgattattgtgcgtgaggtagcgcacataatccagtattcacgcccataattgttgaaattgtcgctgcctttcatgacatctgttccggtgcgaaaatgatggcaggacaaagggcatatttgttaacgcaacgttatttaaatgatgaagcatgtttatgtattacggaagtgaaagttactcacaacgcggtgaataatctgtattatgaagaatctgcataccttatcaggttcactataaaaggagcccccgcatggaaatgctcgaagagcaccgatgttttggcggctggcagcagcgctggcgtcatcatgccgccacgctaaactgcgccatgacattcagcatttttcttccgccgactcaggataatgaaccgcctccggtactgtactggttgtctgggttgacctgcaatgatgagaactttaccaccaaagcaggcgcgcagcgtatcgcagcagaactgggcattgtattggtgatgccggataccagtccacgcggtgaacaggtcgccgacgatagcggatacgatttaggccacggcgccgggttttatctcaatgccacacagccgccctgggccagccattatcgcatgtacgattacctgcgcgatgagcttccggcgcttatccagacacagtttaacgtcagcgaccgttgcgccatcagcgggcactcgatgggcggccacggcgcattaatcatggcgctgaaaaatccgggcaaatacaccagcgtctctgcttttgcgcctatcgtcaaccccagccgcgtgccgtggggaatcaaagcgcttaccgcttatctcggcgaagatgaatcagcctggactgagtgggatagctgcgaattaatgctggccagccagccgcaggacgccattcctgtgctcatcgatcagggcgacagcgatcaattcctcgccgatcagcttcagcccgccgtactggcggaagccgcgcggcaaaccgcctggccgatgacgctaagaatccagcctggctacgatcatagctattattttattgcgtccttcattgaggaccatctgcgctttcatgcccggtatttacgggacgagcgtgagacgtcaccaacataatgaattttccagcgccgcgctgtaattcacctcctccgactgcggcgcggaagatttattatttaaatccgcggcctgctggcgtacctgaaggcggccgctgccctctccgccttcataactttcgtgaaaattacgcagctcggattcaaacagcaccgcatcaagattatgcaacttatccagcgcccgcaggagagaaattaacgtatcaagattgagccctcctcccttctcgatacgcttgatggtggcaatgccaacgtgcgcgcgatcggcaagctgctgctgggtcatcgaaagagacagacgcgtctcctttaagcgggcgcacaacgacaggataatctcatcgttattcatcgtattgtatttcacgctgttaccctctcttgcgcggctgaattttccccagcgaaccatgatacgtttcacggtatttagcgctcatgtctttaccggtctcgtacatcgcagcaatgatctcatcgagcgaaatacagggttcgcttacgcgactcatcgccatcgtcgccgcgtttatcgctttcacggcagagatagcatttctctctatgcagggaatttgtacctgtccgcccagcggatcgcaggtcaatcccagatgatgttccatggcaatttcagcggcgctcagcgtttgctccacggatgcgcccattagttcagccaggcccgccgccgccattgagcacgccacgccgatttccccctgacagccaacttcagatcccagaatagaggcgttttgtttaaacaacatcgcgatagcggcggcggtcaggaagaaacgggtcagagcaccgggctccagcggcgtgacaaatttatcataccagcaaagcgctgccggaatgatgccgcacgcaccattggttggcgcggtaacaatctgtccgccgctggcattttcttcgcttaccgcaatcgcgaaggcattgacccagttcagcgcggttaaaaaatcgctggcggagcgattagcctgtaacgtcttatgtaacgcgcaggcgcgccgcggtacctgataggggccgggtaataccccctcagtatgcaggccgcgataaaccgcctgctgcatcacgtcccatatttgcgccagataattctgcaacgtctgtggcgagtggcggcacagctcatttttcatcatcagcgccgccacggacaggccgttacgccgacacagcgccagcaactgcgcggcatgactaaattcaaagggcgacactgtacgcaaaggaagcgatggcgtcagcggctcgccatgtttgcgaacctgtccggcgccggtcgaaaaccaggtctcttcatacaccgtgaaataatcatctctggcgcgaaacgtcatggcataaggatggcctggatgcgcctggtgattggcgataatcttgacttttatcgtgattccgcccgcgtcggagagcgggagttcgattttgttttcattttccgcacgcttaatcaccgccatatacgaacggagatcgacattctccggctggcaacccagcagcccaagataaagggcggtatccacattgtggcacttgcggcttaacgataacgcgccatacagctcgatttcaatttcccgaattagcggtaacgtctcttgttctctgagcaatgaaataaagtgacaggcggcgcgcatcggccctacggtacgtgagctggatggacctattactattttgaatatatcaaggcaactctccatcgttatatcaatcctttcagtgtcattcgcgttcagtaataaataacatcctcgcacagttggcatatcaaaagtgataccttttgtgtctgaactttacctggtatcaaaaacaacgcttttttagcccttttctggctgtgatatctgtgatagcacgagattccacgccgcaaaagagccattataatacccgtaaattaagggagttatcatatgagcattatttattttattactacacaggatatcgatacgtttcagaaaaaattacaggaaacgttatttaatgccgtcaccatgccgtttccgctattatttgataaacgttatgccgcgcttatcaataccgcttatttaaagcttacgctgccagcggaatgtctgacgcctgaattttatcgctatttacgcgaactctcattgcaatggcagtttgatttttttattaagccgcagccactgcctgctaacggtattatcgcgtttgatatggactcgacatttattgcggaagaaggcgtggatgaaattgcccgcgagcttggcatgtcgacgcaaatcaccgccattacccaacaggcgatggagggcaagcttgattttaacgccagttttacccgacgtatcggaatgttgaaaggcacaccgaaagcagtgctgaacgccgtatgcgatcgcatgaccctttcgccaggcctgttaactattctgccagtcatcaaggccaaaggatttaaaaccgcgattatctccgggggactggatatattcacccagcgtctaaaagaacggtatcaactggattatgccttttcgaatacggttgaaatacgcgataacgttctgacggataacattaccttgccgattatgaacgccgcaaacaaaaaacagacgctggttgacctggctgcccggttaaatattgccacggagaatattattgcctgcggtgatggcgccaacgatctgccgatgttagaacatgctggcaccggtattgcctggaaagcgaagccggttgtacggaaaaaaatccaccatcagattaattatcacggtttcgaattgcttctttttcttattgaagatgaattataacgcgactcacctcgccggaagggaattttaaaatgagtataaaaacatttattttcagccagcccgataagccgattgtaaaagagaaaaaagagatagaccagacctataaaaaatttcgttttgagattatcgcctcggtctttatctcttatgccgtcttttatcttacccgtaaaaacttctccgccgcgatgccggccatgctgacggaaacgtcgctgaccgcagaagacttcgccattatgtcttctattttttacattctttatggcgcgatgaagtttgtcggcgggatgctggtcgataaaattaacccgaaagccatgaccggcccggtgctgattggcgtggggattgtaaatattctgttcggcttttccgacagcgtggcggcattctacgtgctgtacagtctcaacgcgatattacagggcaccagctttccgccgatggcgaaaattatggcctcgtggttttcgaaaaacgaacggggacgctggtgggctatcgttgaagcggcgcacaatatcggcggcagcctcgcgccgctgctgaccagttttgctatcgcctttagcggtagctggaaaatgggattttatgttcccggcgccatttcgctgctgatggggatagtggcgctatttaccattaaagatcgtcccggtacgttaggtttgcccaacgtggggcagtggcgtaacgacccgacggaactggcccaggtcaaggccagcccggtcaacctgagcttctggcagatttttgtgaaatatatcctgaccaatccactggtatggatcattattatcggtgatatgtcggtttatattgcgcgcactatccttaacgactggccgcagatttactattcgcaggttcacggctggagcctgataaaagcgaactcgattatttcctggtttgaggcgggcggactggcaggtgggttgctggcaggctacttgtctgactttatgttcaaaagtaaccgctggatgaccggattaatcttcgcgttagcgctgtgcatatgcatcgtgctggtgccgctggttcaggatacctcttacaccctcaccgcgattctgttcaccatcatgggcttcgccttatacggaccgcatatgctttttgccgtcggctgtctggatgtgacccataaggatgcggcgggatcgattaccggctttcggggattgttcagctatgtcggcgcggcaatggccggtgtgccggtaattatggtgaaaaatagctgggcgtggtcgggcgtttatatctatgcggtgatcgccattctgctaacgactctgtcgctggcgctgctctccaggctgcatcggttataacattctggcgacagcggcaaaacgcggctgtcgccagtctctgtcagaaacggtaatccaccgccataaagtaacgacgtccgtcttcggtataaccgtagtcgtcgcgtttgagatctttatcgcccacgttcagaacgcccgcacgcagtttaacgtttttcgtcgcctgccatgccgcgccggtatcccagaccacgtacccgcccggcgttttcgctgttgcgctgtcggcccgcttacgcccggtataattccctgatacgtagaatgaccagtcttcgagctgcaccggtttccagtccagcgtaccgttcgcggtgtggaacggcagatcggaaagcggcttgttcccgccattactgacgtcgcgcccgtcgttataggtgtaattcaacgacagtttccacgcctcgttaaacggaactttcaactcggtttccacgccctgaatacgcgctttattcacgttgtaataacggaagaccggaacgcgctgtccccgactgttggtttcgaaaccgacaaagttggaatagccgggcgcggcgttaacgtcaggggtacggctaatgctgatgcgattgtccacatcgttacggaacgtggtaacgctcgcttccacgccctccagtatgccttcttcgccccggtaataaaggccgagctcccagctttcactggtttcaggtttcagatccgggctaccgacaatgcggcatccgccacggcaggagttggtcgcccagtccgggcttaattgcaatagcgacggcgctttaaaggccgtggcccacccacctttcaccgtcagggtatccgttgcgttatagaccagataagcacgcgggctccagtgatcgccataggtttcatggtcatccatacgaataccggtggtcagcgccagcggttcgaagatgcgccactcatcttcaaggaacagagcgtactggctggcggaggttttagtactggaaccgccggtcaggttcaccgcatcgctcagtttatcgtgacgccattcgccgccgaaggtgaggaactggttgacagacgctaacggcagaacgtatttcccgtcaatcgaattgctttctgacgtgatagggctactgttgccggggtttttgttttccactttttcgccgtagaatttgagctcactattgccgagatcccaacgtccgttatggctcaacgcatagttttgccgttccagacggtttttatccagcgagtctgagtcccggtcctggcgatcaaaaccgtagcctgcggtaacgtcatgattttcgtttggtgtccaggcaaactcgacgtttccatcccggctggtaaatccttcaatgcgcggcgtttcacccgtagcggtggtggcggaactctgctgctcgtctttttcgcgtttcgccaggctaccgtaggctttcattcccagcacgccgtcgatcagcggaccgctggtaaagaactgaccgttataagtatcgccacggtcgcgatgttcctgaatagtggagtcaaccgtgacgctgccgtgccatttctgaccaatttttttggtgataatgttgaccacgccgcccagcgcatcggagccatacagcgaggacatggggccacgcaccacttcaatacgttcgatagcgtcaaccggtatccagttcagatcaaaatcattatggcggaagaccgcgttacgggagttaacgcgcttaccgtcgatcaggatcagcgtataactgctgtccagaccacgaatactcacgcctttacggttatccccttcgttagtgagctgtacgcccggcacctctttcaggacatctttcaggttttgcacgggcctgcgctgtaaatcttgctgggtaatgacgctgatacttgctggcgcatctttcagattttgttcgatggcggacgcggtaacgaccatggtttcaccatcatccgttgccgcggcaaccggccaggccaacgtaactgcggacatacaaagccctacccgaacgaaagggttaaacctaaacattccatttctccatgaggtaaatacgacaaaaaaaatcggttatcgctcacaacgcattacgtttcgcctgcgataacggttatcacggcgaactctttttatgcaggcgagtcgggctcatgagtgacggtcgcgcccgaatcttcatcctttctgatttcgagcgtaacgataaagcaaacgataataattatcaatttaattgttaataattatgtcatttgaaccaatcatgaagaaaaaacaaaaaaccctctcgaatgagagggttagaagagtcaggttcaggcagtcagtgccggatagcggcataaagcctatccggcctatgacgagaataccgcgttactttttaacgcgttccgggaagtgcatttcgctatagcgcacgaaatgcgtaccttttatcagcttgtagccgaaccagataagcaggaacagcggaataccgatataggtcgccgcgacgccgccccagtcgatggtatctttcaggaacgcttcatagttctgccccaacgtaataatcaggcacagtacaaaggcgaaaatcggccccagcgggaagaacccggaacggtacggcaaatcattcacatcatacccttgtaacacgtaaccgcgacggaagcgataatggctaatggcaatccccagccaggcgatgaagcccgtcataccggaggtgtttaacagccacagatagaccgtctggttgccaaacattgaggtcaaaaagcaaagaccggcaatcacggtggtggcataaagcgcattgcgcggtacgccgccgcgggacaatttcgcaaaaatacgcggggccttaccgtcacaggccagggtgtagagcatacgggtcgaggcatacatcccggagttacccgcagacagtaccgccgtcaggataaccgcattcattatcgccgccgcagacaacaagcccgcatgctggaacactaaggtaaacggactgacgctaatgtctttgacgtcgttacgcagcaggtttggatcggtataaggaatgatcaggctgataatcaaaatcgcgaaaacataaaacagcagaatacgccagaacacctgacgcaccgcgcgtggaatattcttctccgggttttcagattccccggcggcaataccaatcagctcagttccctggaaagagaagcccacgatcatcgcgacgccaatcattgccgcaaaaccgccagcgaaaggcgcatcgcccgtcgtccagttgctccagccgaccggctcgacacctttaaaaatgccgataatcatcgctacgccaacgatgatgaagataataacggtcgcgactttaattaacgagaaccagtactccgcctcgccaaaaccgcgtacagaaatgtagttcagcaagaaaatgacacagaggaatagcgcgctccagatccagcccggcgtgtccgggaaccaccagcccatcaccaattgcgcggcaaccaggtcaacagcgatagtcaccgcccagttgtaccagtagttccagcccagcgcgaaaccaaagccttcttccacatagttctgaccatatgtcgcaaacgagccagatactggcatataggccgccagctcgccaagactggtcatcaggaagtagaccatcaaaccaatcagaatataagaaaacagcgcgccgcctggccccgcctgagaaattgtcgcaccagatgcaacgaaaagacctgtcccgatggagccgccaatggcaatcatcgtcaggtgacgcgcctttaattcgcgacgtagcgcgggcgcttctgtggttttagttttggaacccatgtgaaaatgctatccatccaaaaaatgaggcgcgattgtaacagacgaaatactatccttccgacacaaatgcgcggttataagagaccttcatgaccggccacggattataagtaaagcagagaataacgtatacgtaagcggatactaaaaatggcgatgccgcccgggcagccctcctcttcacctttattcacagtaactcaaaaaacgctgcaacgcgttagaaagatgtttctgccgatgatgaacacgccacaacgtgcgcaccaggcgcggtaacggcaccgcgacttcgcccagggttcccgcctggagttgttcagcaatcacccggcgcgataaacaacttatccccagtccatgacgcaccgcatgtttgatcgcttctgaattccccaactccatcgccatatgaaagcgcggcaaatgcgacaacagcaaataatcgacaatttcccgcgtaccggaaccgcgctcgcgtaaaatccatggggatgccgcaagctgttccagcgtcaccggcccctgcgtcagcggcgaggacggcgcggcaaagaccaccagctcatcttccagccacggctcagagataatctctgtactgtgacatggtccttcaatcaggccgatatcaacccgaaaatccagcaccgcgttaatcacgtcctggctgtttcccacgctgagttccagcggcaaggccggataatgctggcgatagcgggcaatcatagcgggtaaaatgtaattgccgatggtgctactggcataaacccgtatcgcgccgttatcttcacgaaatagctgctcaatttctatcgcttgctccagcaatgccagcgcgcgcgggtataacaagcgcccatgttcgttgaccaccagccgtttccccacccgatcaaacaactgtacgccgagctgaccttccagatcggtgagcgcggcgctaacggcggactgcgataatgacagcatgaccgacgcctgggttgttgaaccgcttttcagtacttcagcaaacacttcaagttgtcgtagcgtaatatgcatagtcgtatcccaccgatagcgtttcacttaccacttataaagattaattataaatatataatcaattttatttttaaaccagatcaccgtaaccttattgtccatatacaggagaaggttatgacagaactcaccttgcagaatcattgtcgtacaatgtggcattttataccggggctcgctctgagcgccgtcattacaggagtcgccctgtggggcggcgctatccctgccgttgcaggcgcggggttcagcgccctgaccctggctatcctgctgggtatggttatcgggaataccatctatccacaaatatggaaacaatgcgacggcggcgtgctgtttgcaaaacaacatctgctgcgtttagggattatcctttacggcttccgccttaccttttcacaaatcgccgacgtgggcattagcggcattgtgattgacgtattaacgctttccagcacgttcatgctggcctgcttcttaggccaaaaagtctttggtctggacaggcacaccagctggctgattggcgccggtagcagtatctgcggcgcggcggcggtactggcgacagaaccggtggtaaaagcggaagccagtaaggttactgtagccgtcgcgactgtcgttattttcggcaccatcgctattttcctttacccggcaatgtatccgctgctggcgcactggttcagcccggaaacttacggcatctatatcggctcaaccatgcatgaagtcgcgcaagtggtcgcagcgggtcatgccgttagcccggatgcggaaaatgcggcagttatcgctaagatgctgcgtgtcatgatgctggcgccgttcctgatcattctggcggcacgcgttaaacagctttcaccggcgaccggcgcggaaaaaagcaaaattaccattccgtggtttgctattttcttcatcgtagtggcgatcttcaactctttccacctgctgccgaaagccgtggtggatatgctggtgacgctggacacggtgctgctggcgatggcgatggcggcgttgggtctgaccactcacgttagcgcattgaaaaaagcgggggcgaaaccgctgctgatggcgctggcattattcgcctggctgattattggcggtggcgccattaacgtcctaatccatagccttatcgcataaattattacgtttcacgcctgttaacccgttatcatagcgttcgtaatgaaccgttagcgggtttaacaggagtcttttatgaaatacatcggagcgcacgtcagcgctgctggcggtctggctaacgcccctgcccgcgcggctgaaattggcgcaacggcctttgcgcttttcacaaaaaaccagcgtcagtggcgtgccgccccccttactccccaggtcattgatgactttaaaatcgcctgtgaaaagtatcatttctcggcggcgcaaatccttccccacgatagttacctgattaatctgggccatccggtcagtgaagcgctggaaaaatcacgcgatgcctttctcgatgaaatgcagcgctgtgaacaactcggcttaaccttgcttaattttcatcccggtagccatctgatgcagattgcacaggaggattgcctggcgcggatcgcggaatccatcaatattgccctcgcgcagaccgagggcgttacggcggttatcgaaaatacagccggtcagggcagtaatctggggtttgagtttgaacagttagccgccatcatcgacggcgtggaagataagtcgcgcgttggcgtctgtatcgatacctgccatgcctttgccgccggatacgatctgcgtacgccagaggcgtgcgaaaaaacattcgccgaattcgggaaaattgtcggatttcagtatttgcgcggaatgcacctgaacgacgccaaaagcgccttcggtagccgcgttgaccgccatcacagtctgggtgaaggcaatatcggccacgatgcgtttcgttggattatgcaggatgggcgttttgacggtattccgctgatactggagaccatcaatcctgatatctgggcggaagagattgcgtggttaaaagcccagcaaattgccgaagcgatggcctgacgctcaatgttcttcaggcaataaaaaaggcagagcgcgctctgccttttttagcgtgtttctcttatgccgcttttgccgtgacttccgtctccggacgtttcaggacggcataagccagccctgccaccagcgtaccggccacaattgccagcaggtatcccaataccggcgtaattgcgcctgggataagcagaacaaacagaccgccatgcggcgccatcaattttgcgcctaccgccatagaaatggccccggtcaacgcgccgccaacgatacagcacggcagtacacgcatcgggtcgcgtgccgcaaacggaatagcgccttcagtgataaagcacagccccagcaccaacgccgctttaccgccttcctgctgcgctttgtcgaacttacggcgcgccaccatcgtcgccagacccagcgctaacggcggtaccatacctgcggccatgatcgccgccatcggcgcgtaagtttgcgtactcagcagaccaacaccaaacgcatacgccgctttgttcaccgggccacccatgtcggtacacatcatcccgccgagaatcgcgcccagcagcaccgcgtttaccgtccccatggtttgcagccagtgggtgagcccttccagaatcccggcaaccggtttaccgatcaggtaaatcatcgccagccccaccaccagactggaaattaacgggatgatcaggattggcttcagcgcttccatactttgcggaagtttcagtttggtactgataagcttcgccatatacccggcaaggaagccggcaatgatcccgccgataaaaccggaaccggtgctaaccgccagcataccgccaatcagacctggcgtaaggcctgggcgatccgcgatggagaaagcgatatagcccgccagtaccggcaccatcagcgcaaacgccgaaccgccgccaatctgcatcagcgccgccgccagcgtgtccggcaccttaaaggcttcaataccaaaggcgaaggaaagcgcaatacacagtcccccggcaaccaccataggcagcatgtaagaaacgcccgtcaacagatgccggtatgcgccagcgctctctttcttcccttcggtcgccgcttgcgatgccttacccgccggttgatacggcgtcgcttccgctacggctttatccagctcctgcgccgtctttttcagcgccaggccggtcgacgtgcggtacatcgggagaccggcaaacttcgccagatccacttcgatatccgccgccacaatcactaaatccgcttccgccacctcttccggggtgatggcattgccggcccccacggagccgcgcgtttcgacttttacccaccagccgcgttttttcgcttccgtttcaatggcttcagccgccataaaagtatgggcgacgccggtcgggcaggccgttaccgcgaccacgcgtttcggaccgccgctcgccgcaggaacagccgcagcaggggcgctgtaaggggtcgcatggcttttggcttcactcagaaacagttccggatgcgcgacggcgcgaccaatatcccccagccaaacctttttgccgttcagagcattgtcgttcggcagagattcgcccagcacgatcgccagctcagcatcattcggattgtcgataatttccagatttgctttatgcgccgccgctccaagcagggttttcgccatgtaagcgcgagcctggccgagattagcgtcaattatcagcagcgttttcattatgcctctcctgctgtcagttaaacggttgtaagtcgacacgcgccatcattgcggccaactgaggacgatcggtaatacccacattgctctggctgaccgccagcgcggcaaccgccgtcgccagacgcagcgtatgttcgctggactcgcgcatcagcaggccgtaaatcaatccgccaaccatggaatcgcctgcgccgacggtacttaccacgtcaaccgccggtggtttagcgatccattctcctgaggcgttaacccacagcgcgccttccgcccccagcgaaatcaccacatgggcgataccctgttcgcgtaacgcgtgcgccgcatcaatcacatctttcatttccgggagcttacgacccgcccaaatttccagttcgcggcgattcggtttcaccagccacggcgcagctttaagaccggcgactaacgcttcacggctactatcaaagataatgcatggacactggctgcgcagacgcgtcatccagtcggtgaacgcttccggactcacgccagccggtaagctaccgctgacgcagaccatatcgaactgacccagccagctcagggagtcgttaacaaagcgttcccagtctgcgggagtcacgtcaaagccggaaaagttgaagtcggtcacttcgccatctttttccgtcagcttcacgttgatgcgggtccggccctgaaccacctgaaagcggttagcgatacccagttcgctgaacaattgctgaaaaccgtcctggttatctttaccgagaaaaccgccgacggtgacgtcgatgcctaagtctttcagcactttggcaacgttaatgcctttgcccgccgcgtgcagacccgtggttttcaccaggttcacttcgccgcgttcgatttcagggcaaaacccaaccagatcgtaagccggattaagggtaatggtggcaacacgcctgctcattatgcgccctccccgagaccggcggcgatcgcatcgccaatcgctttcagcgcctgttcagcatcttcaccctgcgcggtaaagcgcagacgatggcctttcttcacgcctaacgccaccactttcatcagactacgtccgtttgccggtttgccggttccatcaaggtttgtcacggtaatttcactgttaaattgtttaatcgtattcaccagcatggtgcccggacgggcatggagaccatgctcattacgcactacaaattccgcgctcagtacgtcatccgtcagcgcatcatcactggtcagcaacgccagcagcgtcgcggcgtcagcgctcagcagacgatcggctttattgttcagcaacaggtcgccgaggcgttttagcacggcaatcggctgctcatcgttcatcgcgacagtgactaataaggctgctttttcaccctctacgtcaaacgcctgggtcgcacggcttaccgcaacagcgctgcgcaaattgccttccgcgctgtcgttcagccagatgccttgtcccagattcatcggactatcgttaatcgtttttgcgacgaacgccgcatcaaccgctcccgcctctttcagacgcgccgcatttagcgcctgcaatgtgaccagcgagctggcgatgacatccagcgtcatcgtctcgttatcaagttttaattgttcactttgcttctcgcccatcagcaatgcgcgcagctcttccgccgttgtcgcggatttcagctgttcagccacggagtcatcgcttagcacatgcgtcagctgacgcagcaggccgaggtgttcgtccgaactggcggcaataccaatcgccacgtaggcgacctggccttctccccaggtaacgccctgcgggaattgaaagacctggacgccggttttcagcacctgatcgcgcgtgtctgttgtgccatggggaatcgcaataccattgccaagaaaggtcgaggtttgctgttcgcgcgccagcataccgtcaacatagccgcccgccacattccccgcctgcgctaacgcggcggcgatttgccgaatggcctcttctttatttccggcctgctcgcccggatgaatgtcctgaaccgataactggaacatgtgtctcctctcctgctgaattgaaacgattcagccgctatgagaaaaaaagcgccaatctgagttatcaaaaaaaccagatcgcgctgaaacgtttcaagaagtctggatctttctgcttcagcacgcaagaaaagttaccggttttgtagcaattttttgaggtgaagcacattttttctccaacagaccctcaatagctgacgcataaaaggcttcagcttttttctttcagcttgcgtcagcacgccctggtaacaaactggaatgctattttgatttttcgtgtcgattttgattcagacgcctgtttattttctgacgggcagcgtaaactccgcctctcttcacaccactgatatagaaacatgcacaacagtcccgccgccgctgcgcctaaatcgtttgacctgacgtctaccgcctttttgatcgtcgcttttctcaccggtattgccggtgcgttacagacgccgacgctcagtatttttctgacggatgaggttcacgcccgtcccggcatggtgggtttcttttttaccggcagcgcggttatcggcattatcgtgagccagtttctggcgggtcgctcagataaaaaaggcgatcgcaaaaaactgatcgttttctgttgcgtgctgggcatgttggcctgcgtgttgtttgcctggaaccgcaactactttattttgctgttcatcggcgtctttctcagtagcttcggctctaccgccaacccgcagatgtttgcgctcgcccgtgaacatgccgatcgtacaggtcgtgaagcggtgatgttcagctcaatcctccgcgcccaggtctcattggcctgggtcattgggccgccgctggcctatgcgctggcgatgggttttagctttacggtgatgtatttgagcgcggcggtagcttttatcgtctgcggcgtcatggtgtggttctttttaccgtcaatgcgcaaagatgcgccgctggcaaccggcacgctggaagcaccgcgtcgtaatcgccgcgatacgctgttgctgtttgtcatctgtacgttaatgtggggaactaacagcctgtatatcattaatatgccgctgtttatcatcaatgagctgcatcttccggaaaaacttgcaggcgtgatgatgggcaccgccgccgggctggagattcccacaatgctgattgcaggttacttcgccaaacggttgggaaaacgcctgttaatgtgcatcgccgttgtcgccggactgtgcttttatgtgggtatgttgctggcgcacgcaccggcgacgttgctcggcttgcagttgctgaacgcgatttacatcggcattcttggcgggattggcatgctctattttcaggatctcatgccaggccaggcgggttcagccaccacgctgtataccaataccattcgcgtcggctggatcattgccggttcgctggcgggaatcgccgcagaaatctggaattaccatgcggtcttctggtttgcgttagtcatgattgtcgccaccatgttctgcctggcgcgtattaaagatgtttaacttgcaagcctgatacttttactcttcgacacatttcagcgcagagtttatctctgcgcaatgttcatgcgcggtcattcattgtctttttctcaatacgatattctgttagcgccctcttacataagagaccggttattgagaaaattacgcccatcagtccgcaaagaaccaacaccagccgcatcttatattttggtgtgacagcaacatctatcacttcaatgttagcattatttttaaccgcctccgacaacaaggatagctttgcatatgtttccgtttgtaacatatttttatgcacgctataacgtttaatgtcaccatcatcgatataccatgccgccattttatcgacactatttttcagggtggaaataatattattgacgctttcttccctcccctgcgccttaaaaagaacaagctgatttttcgcgtcaaaacttattttatttttatattccgcaggcaagaaacggctaaactggttaaggataaccgttgttttacattgaatatcattagtatagccacataacgcataggtagcaggcgtatccagattaggtttgattgtcatactcacaacctttgtatcatgctgcacgctcacaaaaacatagccaatggcaacaaaaataaaggtagcgatcatgatacttagccattttcttataaggaataaggaaacgtcgactaaatcaatttcactattttctccccgcatttcacatcccttttaaaacgctaatagtcaacccgaatactgaaataacaaaaagcaacaccagcgtaaaaataaacgccctggctgcgaacgtatatttcttcataagataaaacccacacataagaattcgagtattttaaaggaaaataacaatacattcacactggttatatcgatcggtaaatacatcaatgatagatataaactatcaaattcatgatatcgatcgttataaataattaaaatcgatcaaaattcctctttttaatagataaaaactatcatataaataaaattgatcgtttttgttttatgtgacggttcattcggtacacgttcaggcaccaacggggttgagcggcgacatctaccgcttcagaagccacgaaataagggaatcatgtattacgctatttaatggtaaaaggaggtaatttgaggcgcagcttttgcagactatttcgggatataacgtaagcccctgcacgtttatcaaaaacggcatagctcatggtaaggttttctgttcgagttccagcaaataaataatggcctcttcccgggtcgttaaacacatgtcccctgtcggttgcaaaccagagcacacttttgggcgtaaaggcgagccaaagataaggcacaagttatcttccgaaagctgcacgcatctggtattcatcggcttgccatacggcattccgggtatcggcgacgaaattgaaggcgcaatacagcaagcgccacaaccgctacgacagtccatgctcagccctctatttataaccaaatgaaagataacagaatttgtccaaagaaaaatccagatttaaaatgtggacgtcatcatgatcagacctgccctcagacattccgaagacaaggctggaaacagaagggacaacacagcacacttcccccctccgggcgacatgccatcgcgtattctcgttgaacgcggggcggaaagcgggcgaacagtatcaccttttttgcaccagcaaaagtgacaattccacttgcctggatggcccggcgcgagtagttttacgcgatattttagataatctctacaacaggatctcctcgatgccaagagcgaacgaaatcaaaaaaggtatggtactgaactacaacggcaaattgctgattgtgaaagatatcgacattcagtcgcctaccgcccgtggcgccgccacactgtataaaatgcgtttttccgatgtccgcaccggtctgaaagtggaagaacgtttcaaaggcgacgatatcgttgataccgtcaccctgagccgtcgcggcgttgacttttcttatgtcgatggcaacgaatatgtgttcatggataaagaagactatacgccgtataccttcaccaaagatcagattgaagaagagttgctgtttatgcctgaaggcggaatgccggatatgcaggttctgacctgggacggccaactgctggcgctagagcttccgcagaccgtggatctggaaatcgtcgaaaccgcgccgggtattaaaggagcgtccgccagcgcacgtaacaaacccgcgacattaagcaccggtctggtgattcaggttcccgaatacctgagcgcaggtgagaaaatccgcattcatatcgaagagcgccgttatatggggcgcgcggattaagtttcacatttttcggctgcgccccagggcgcagtctgccccttttatttattgactgttctgcaccaggcaagagaaacgttaaaaatttaacattttctgctcttaagatggcagcagcacgacttcgtcaactcagcacttctctttttcacgtttattcgccaggattattaaaagttgttatgttgtatcaatatcctggagctgacgtgaccaaaaccaatcttattactggatttctcggtagcggaaaaaccacctctatccttcatttattagctcataaagatccggctgaaaagtgggccgtcctggttaatgaatttggtgaagtgggtattgacggcgcgctgcttgccgacagcggcgcactgctaaaagagatccccggcggctgcatgtgctgcgtcaatggattgcctatgcaggtggggctcaacacgctgctgcgccagggcaaacctgaccggttgctgattgaaccaaccggactggggcacccaaaacagattctggatttattaactgcgccggtttatgagccgtggattgatttacgcgccacgctctgcatccttgaccctcgtctgctactggaccaacagagtgtcgccaatgaaaatttccgcgatcagctcgcctcagccgatattatcatcgccaataagaccgatcgcgccacggcgcagagcgatgccgccctgcaacagtggtggcgacagtacggcggcgatcgtcaactgattcatgccgaacatggacagatagacggtaagcttctggatttaccgcgacaaaatctggcggaactgccggccagcgccgcgcattctcacactcatgccagtaaaaaaggactcgccgcgctaaatctgcccgcccagcagcgctggcgacgcagcctcaatagcggacaaggtcatcaggcctgcggctggattttcgatgccgataccgtgtttgacaccattggcctcctcgaatgggcgcgtctggcgccggtgggccgggtgaaaggcgttatgcgcatacaagaggggctggtacgcatcaatcgccagggcgatgacctgcacatcgaaacacagagtgtcgcgccgccggacagccgggttgaacttatctcaaacacagaaaccgactggaatacgttacagacggccttgttgaagcttcgtttagcgacgcacgcgtaaggttgccaccgtttaaaaactatggcgaaatgacgatgaaaacccgctattccttgataattctgcttaatgccgccggtctggcgctgtttttgtcatggtatcttcccgtcaatcacggcttctggttcaccattgattccggcatattccacttctttaaccagaaactggtggaaagccacgcgttcctctggtgggtcgctattaccaataatcgggcgtttgacggctgttcgctgctggcgatgggcggactgatgctcagtttctggctaaaagaaaacgcatcgggccggcggcgcattgtgataatcggattggtcatgctactaacagcggtggtgcttaaccaactcggtcaggcgctgatccccgtcaagcgcgccagcccaacgctctcttttgagcatatttatcgcgtcagcgagttgctgcacatcccgacaaaagacgcgtcaaaagacagtttcccaggcgatcacggtatgatgctgctgatattttccgcctttatgctgcgttatttcggcaaaactgcggggattatcgcccttattatatttgtggttttcgcgtttccgcgcgttatgattggcgctcactggttcaccgatattgtggtcgggtcgctcacggttattttgattggcctcccctggtggctgatgaccccgctcagcgaccgggcgatagcgctttttgagaattatctcccgggcggaaataaacaaattttaaacaaataacctatgtaattaacattaccttcagcgatagttttacatcgttgaaggtaatttatgatgatattcccccagcccatcatttttcggtcatattattcctctgcaaaatgaacagtttgcccgatttttaaacgatttgcgcttaatttgacccgtgctgatagttcactttttgtatcataaattcttataaaaaatcacgcgaaatcgctcgcaatgacagcaacaatcgggtaatctcaaactcgttttgcctcgccagataattattctcattgcgaataaatttgtgcgttccgccacagatttgtgcacaaagaattgtctcaagctgtgcaggtaattagtctcatcacgtttggcatttttataacgatatttatcgttaaggacttcaagggaaaacaaacaacatggtcaaatctcaaccgattttgagatatattttgcgcgggattcctgcgattgcagttgcggttctgctttctgcttgtagcacaaccaccaataccgcaaagaatatgcattctgagacgcatgctgtgggcaatagcgatagctcttcactgcaagcctctcaggatgaatttgaaaatatggtgcgtaacctcgacgttaagtcgcggattatggatcagtatgctgactggaaaggcgtgcgttaccgcctgggcggcagcactaagaaaggcgtcgactgttccagctttgtacagcgcaccttccgtgaacagtttggtttagagcttccgcgttcaacctatgaacagcaggaaatgggcaaagcggtttcacgcaataacctgcgtacgggcgatctggttctgttccgcgccggctccactggtcgccatgtcggtatttatatcggcaataaccagtttgtccatgcgtctaccagtagcggcgtcattatctccagtatgaacgaaccgtactggaaaaaacgctacaatgaagcgcgtcgagttctgagccgcagttaatcttcatcaggcagcacctcccttggcttacctgatgagacgacataaaaagcactgcttcagcagtgcttttgcttattatcccttctgaacccgttttgccgaatggcgacgtgtggcgtcttatccagcctacaacacacgaacgtaggcctgataaacatagcgccatcaggcattcaggtcgtttcccccaacggctactgcgacaatacgctttcctgcgcatcacagaaaagcatgactatccggggtaatccaggctatagtcttataaatcaaccagtttaaccggcatccgccttttcaggtcacaccaggaattatgctaacacgcgactcctcttccggtcggaaaatcctgcttacctgtatcattacggggatagcggcagcattacttattggtagcctgcaatttttcctgtcgtggcataaacgggatgttaaatacaatacgctcctttctgatgtacaacattacctggccagctatttcgccgacctgaaagccaccaccgatattcttcaaccgttgacgatcaacacctgtcagcaggttggcgcagaactcacctcaagagccgcttttagccttaatgtccgcgccttcttattgattaaagataaaaaagtgttctgctcttccgccactggcgccatgaatatgccgcttcagcaactggtaccggatatagatatccgcaaagacgttgctatggcgattctgcccggcacgccaatgatgcccaacaaaccgacaatggtgatttggtatcgaaacccattattaaatgacagcggcgtattcacatcgctgaatattaacctgacgccctacttactctataccacgcgccaggatgattttaacggcatcgcgctgattgtcggcaataccgctctgtcgaccttttcttcgcgtctactgaccgtcgcggagctgccgggcacgccatcacgactggcaactatcaacggcctgccgcttaaaatacggctttatgccgatagctggacctacaatgacttgtggtatgcgttgatgctgggctgcattagcggcatcgtagcagggtttatctgttactttatctatgccctccggacgcgaccgggcaaagagattttaacggcgatcaaacacgagcagttttatgtggtttatcagcccgtcgtcgatactcgtacgctgagcgtcaccgggcttgaagtcttactgcgctggcgtcaccctacggcaggcgagattccgccggatgcctttatccactatgccgaagcgcagcaacttatcgtaccgttaacgcagcatctgttcgagctgatcgcccgcgacgcacccacgctacagaaggtgatgcccgtcggtgccaaatttggcattaacatcgcgccggaacatctgcacagcgacagttttaaagaggatatgcaccggctcagggacgccctgcccgcgcaccattttcatatcgtgctggaaatcactgaacgcgatatgctccagcagtatgaagcggccaaactgttcgaatggctgcattccgccgggtttgaaatcgctatagatgatttcggtacaggccatagcgccctgatttatctggagcgatttactttagattatctgaaaatcgatcgcggctttatccaggcgatcggcacggaaaccgtcacgtctccggttctggataccgtgctgacgctctccagacgcctgaatatgctgacggtggccgagggcgttgaaacgccggagcaggcccgttggctacgcgatcacggtgttaattacttgcaggggtactggattagtcgtcctttacccctaaaagatttcgtgctgtggatgtcggcgccttctgtgcctgaatggtagcccccttacggttttaacggattcacatcagacgcaacgtcacttattattcagcgaaacgcctgccggtttgcagcgggcaatacgataaggaaaccgccttcagatgattgcgcgcgtaatgcttctgcttgtcgcactggttagcgctggcgcccaggcccaggaaatcaaagaaagctacgctttcgccgtactcggcgaacctaagtatgcttttaactttgagcactttgattatgtgaatcctgctgcgccgaaaggcggtcagatgacgctttccgccattggtacgttcgataatttcaatcgctattcgctgcgcggcaatcccggcgtacgtaccgaagccctttacgatacgctttttaccacctcggatgatgaacccggaagctattacccgctgattgccgaccatgcccgctatgccgccgactattcctgggtggaaatctcgattaatccccgcgctcgttttcacgatggcacgcccattaccgcccgcgatgtggcctttacctttcataagtttatgaccgaaggcgtaccgcagttccgtctggtctataaaggtactaccgtgaaggcgattgcgcctttaaccgtgcgaattgagctggcgaagcctggtaaagaagacatgcttagtctgttttcattaccgatcatgcccgaaaaattctggaaaaatcacaagctcagcgatccgctttcaacgccgcccttagccagcgggccataccggattactcagtggaaaatgggccagtacattgtctattcacgcgtcaaaaactactgggcggctaatctgccggtcaatcgtggacgttttaacctcgacactatccgctacgattactaccttgatgacaatgtcgctttcgaggcgtttaaagcgggcgcatttgatctacggctggaaaacgacgctaaaaactgggcaacgcgctatatcggtaaaaatttcgataatcattacatcattaaagaagaacagaaaaacgagtcggcgcaggacacacgctggctggcctttaatattcagcgcccggtatttaaagaccggcgggtacgtgaagctgtcaccctggccttcgattttgagtggatgaataaagcgctgttctataatgcctggagccgaaccaacagttacttccagaataccgagtacgccgccagaaattaccctgacgccgatgaactggtattactcgcgccgatgaaaaaagatcttcctcctgaagtcttcactcagatctatcagccgccggtctctaacggcgacggctacgatcgcgaaaatcttcttaaagctgacgccttgttgacgcaggccggatgggtgatcaacggacagcaacgggtcaatagcgtcaccggtaagcccctgacgtttgaacttctccttcctgccagcagtaatagccagtgggttctgcccttccagcataatcttcagcgtctgggcattacgatgactatccgtcaggttgataattctcaactcaccaaccggatgcgtagccgcgactatgacatgatgccgaggctatggcgggcgatgccctggcccagctccgatctacaaatctcatgggcgtcggaatacattgactccagttataacgctcccggcgtacaaagcccggtggtggataaactgatcgcgcaaattatcgcagcgcagggtgataaagcgaaactggtgccgctgggacgggcgctggatcgcgtgctgacctggaactattacatgctgccgatgtggtatatggcgcaagacaggctcgcccggtgggataaattctcccatccggcgattcgcccggtatataccatcgggttagatacctggtggtatgatgtcaacaaagccgccaaactaccggcagccaggaggtagtaagaatcaatgggcgcctatcttatccgccgtctgttactggtgatccccacgctatgggccattattaccattaacttttttatcgtgcagatcgctcccggcggccctgtcgatcaggcgattgccgcgattgaatttggccagggcggcgcgttgcccggcgccagcggcgaaggcgttcgcgccagtcatgcgcaaaccggcgtcggcaatatcagcgacagccattatcgcggcggccggggactcgatccggaggtgatcgcggagatcacccatcgctacggcttcgacaaaccgctgcatgagcgttatttcaagatgctacgggactatctctcttttgacttcggcgacagtctgtttcgcagcgcatccgtactaacgctgatcaaagatagccttcccgtctccattaccctgggattatggagcacgctgattatttatctggtgtctatcccgctggggattcgcaaagccgtccataacggcagtcgctttgatgtgtggagcagcgcgtttatcattattggttatgcgatccccgcctttctgttcgctattttattaatcgtcttttttgccggcggcagctactacgatatctttccgctacgtggcctggtctcagccaactttgacacattaccgtggtaccagaaaatcaccgattatttgtggcatattacgctgccggtgttggcgaccgtcatcggcggttttgccgccctgacgatgctgacgaaaaattcgtttctcgacgaggtgcgtaaacagtatgtcgttaccgctcgcgctaaaggcgtgagtgaaaaaaacattctctggaaacatgtttttcgtaacgccatgctgctggtgatcgccgggtttcccgccacttttatcagtatgtttttcaccggctcgctgctaattgaagtcatgttctcgctcaacggcctggggctgctgggttatgaagcaaccgtttcgcgcgactatccggtgatgttcggtacgctttatatctttaccctgattggcttattactgaatatcctgagcgatatcagctatacgctggtcgatccacgcattgattttgagggacgataatgccgcgattaagcccggtcaatcaggcccgctgggcgcgtttccgccataatcgccggggctactggtcactatggattttcctggtcgtgttcagcctgagcttatgcgcggaactgattgctaacgataagccattgctggtgcgctatgaaggccagtggtattttccgctggtaaaaaattacagcgagcgcgatttcggcggcccgctggcgacaacggcggattatcaggacccctggctacaacggcagcttgagaatcggggctgggtgttgtgggcccccgtacgctttagtgccaataccattaattttgccaccacgcagcctttcccctccccgccttcggcgaaaaactggctgggcaccgatgcgaatggcggcgacgttttcgcccgcatcctgtacggcacccgcatttctattttattcggcctgatgttaacgatttgctccagcgtcatgggcgtactggcgggcgcgctacagggctattatggcggcaaagtcgatttatggggacaacgtctcatcgaagtctggtcggggatgccgaccctgtttctgattattttactttccagcgtagtgcagcctaacttctggtggctgctggccataaccgtgctgtttggctggatgagtctggtgggcgtggtgcgcgccgagtttttacggacccgcaattttgactatatccgcgccgcgcaggcgcttggcgtcagcgatcgtgacattatcctgcgccatatgttgcctaatgcgatggtcgctaccctgacatttttaccgttcattttatgtagctccatcaccaccctgacgtcgctggattttctgggattcggtctgccgcttggctccccttctctcggcgaacttcttttacaggggaaaaacaacttacaggctccctggctggggatcgccgcctttctgtctgtcgccattctgctatcgctgctgatttttatcggcgaagcggtacgcgacgcctttgatcctgctaaggcggtataagatgacatctccattgcttgcgattgaaaatttatcggtaggtttccgtcagcaacagcacgtgcgccctgtcgttaacgccatttcgttacaggtgaacgccggggaaacgctggcgctggtcggcgagtcagggtcagggaaaagcgtgacggcgctttccattctgcgtcttttgcctacccctcccgccgtctacctctccggcgatattcgctttcacggcgaatcattgcttcatgccagcgagcagacgttacgcggcgtgcgcggcaataaaatcgccatgatttttcaggaaccgatggtttcacttaacccactgcatacgctggaaaaacagctctatgaagtgctgtcgctccatcggggaatgagtcgggaggcggcaagggcggagatgatcggttgtctggatcgggtcggtatccgccaggcgagccagcgtctgcgcgattatccgcatcagctttccggcggcgaacgccagcgcgtcatgatagccatggcgctgttaacacggccggaattactgatcgccgatgagccgaccaccgccctcgacgtctccgtacaggcgcagatcttatctctactgcgggaactccagcgcgagctcaatatgggattgctgtttatcacccataacctcagcattgtaaaaaaactggcggattcagtggcggtaatgcaacacggcaagtgcgtagagaaccaacgcgccgacacgctgctctccgcgccgacccatccgtacacgcaaaaactactcaacagcgaacccactggcgatccggttccgctccccgccgggcaggcgccgttgctggaagtggacaagctgcgcgtcgccttcccaatccgcaaaggcattctgaagcgcgtcgtggatcataatgtggtggttaacaatatcagtttcaccctgcatccaggcgaaacgctgggtctggtcggcgagtcaggatcgggaaaaagcaccaccggtctggcgctgttacggcttatccgctccgaaggccgcatcgtgtttgacggtcaatcgctggatacgttaaaccgccgccagcttttacctgttcgccaccgtatccaggtcgtattccaggacccgaactcatcgctaaacccgcgtttaaacgtattgcaaattatcgaagaaggcctgcgcgtccaccagcctacgctttcaggcgcgcagcgcgaacagcaggtgaaagcggtcatgatggaagtcggcctggacccggaaacgcggcatcgttaccccgctgagttttccggcggccagcgtcaacgtatcgccgtcgccagggcactgattttaaaaccgtcgcttattattctggatgaaccgacctcatcgctggataaaaccgttcaggcgcagattcttgccctcctgaaatcgctccagcaaaagcaccgtctggcctatatcttcattagccacgatctgcatgtagtacgcgcgctgtgccatcaggttattgtgctgcggcagggggaggtggttgaacaggggcaatgcgagcgcgtgtttaccgcaccgcaacaggcctatacgcgtcagctactcgcgttaagctgacgcctaaaaaggattattgttagaaaaaggttccgctatcgccacgccgaaatttttcagccgacaggtggcggcaaactcatcctgacgattaacgaacaggcacggctccccttcgcactccagcacggagcaaggaacttcaatatcgcttagcgcctggctgagcttatgcatcactgaccacgcgctatcgcctgccggactcaacagtttaagcgccaccagactattctcggtgctctgcccgttttgcggaatcggttcaacctttgaccccgcaaaacccgccgaccagcgatagttttgcggcagacggtgaacaattgagagctgtaatgtattcactttctttccccggaagcacaattacttcacaatttacttacatttatattaacacatcattgacaacccgtccttaaacagattgctaacgcccttctctccgtcagtggctctacagcaagcgggagttaaaatagttttaccgacacggagatagcggcgggctatatgtacccgtttctgcgatctaactcaacctttttaactacaatgatgtgactttttacataaatggattttacataaaataaacataaaggaggaaaatgatgaattggtaattgatatacatcaactatgaaagccgtttggctttgccatcgtgtagcggatagcatcccccaacgccgcctgcgcattcttcggcgccattgagggacagcgcgcccgtcaccgttttttgggacggctggcgtagagataaaacagaatggaacaggcggcgcaaagcgcaatcgaccagatcatcggccacgcactgttaaaggtagccagcgacagcaacgcgccgacgatagcgccaataccaaagcggaaagtgcccgccaacgaagacgccgttccggccatatgcggaaactcatccaaaatgaccgccatcgcattggacgaaaccatcgacacacagccgacaaacgccgcaacgccaaccaccagcgcccagaatccaatgcccatcagcgcgctgaaaaccatccacaccgccatcgcaaactgaatccatagcccggcccgaaacatgtttagcgcccctacccgtctgacaaaacggctgttgataatcgtcatcacaaacagaaatacgatgttcaacgcgaagtagtagccgaaatcctgcggcggaacatgattaatttcgatataaacaaacggccccgcgctcaaaaaagagaacataccggcaaaactaaacccgctcgccagcatatagctcagtacgcgtttgtggcgaaacaacgcggcaaagttacctattgtggtacgaatatgaaaaggctgacgccgctcaacgggcagcgtctctttaatcagagcaaagatcatgactgacgccagaatcgccgcaatggccagtatccagaagatatagtgccagcttaaccataccaacacccagccgccgacaatgggcgccattaacggcgctatcgtagtgaccagcatgacaaatgacatcatgcgcgaaaactcttcctttggataaatatcccgcatcagcgcattgatgacgacgcttgccgccgcggccgccaaaccgtgaaagaaacgcatcacgatcagttgatcgatagtctgcgccaacgcacaggcgaccgccgcagcggcaaataccagcgtcccgcccaggatgaccggcttacgcccgaggctatccgccatcggtccatagataagctgacccagcgcaaaccccaaaatataggtgctgagcgtcatctgcgcgctaccggcaggcacgccgaattgcgcagaaatcaccggcagcgctggaagatacatatcaattgacagcggcattaacatggccaacaggccaagaataaagacaatggcaaaggaagagtgctgccgggtggtcacatcgaactcctgaatttaacgagatagttagccgacgctggcgatttcttcttcagtcaacgggcggtactcgccgggagccagattctcatccagcgtaatggcgccaatccgttcgcggtgcagttccacaacgcgattgcctactgcggcaaacatccgcttcacctgatgataacggccttcgctgatggtcagacggacctgcacaggtgttatcacctccagcgtagcgggtttagtgagatctttttcattatgcaactgcacgcctttcgcaaattgcgctgccgtatcgtcggccaccggcgactccagggtcaccagataggttttttcacagtgatggcgcggcgacgtaatgcggtgcgaccactgaccgtcatctgtcattaacaccagaccggtagtatcgatatccagacgtcctgcggcatgcagcttatacgccaccggctcatccaggaaatacagcaccgttggatgatcgggatcatcggttgaacaaacgtatccctgcggcttgttaagcataaaatagcgtggcccgtgttgctgcgctaagggattgccgtcatacgcaaccgcatgttctgggagcagtttgaaggccgcatttttaatgatgtcgccatcgacggtaacgcggttaccacgaatttcacgcccggcaatagcgcggctgacgccaagctgctgagcgataaatttatcaagtcgcatgtgtgtgatttagcctgtaataatacggaaatcgggcattctacccgaaaaaagggaattgctatccgctcagtatagcgggctaactatatccctcaagggaaatgattcatggcatactattcccggaaccgtttaacgtagtgagaccatgatttttacactccgcccctaccagcaagaagccgtagacgccacgctcagccactttcgccgccaccgtacgcccgccgtgattgttctgccgaccggcgcaggtaaaagcctggtgatcgccgaactggcgcgcgtcgcccgcggacgggtactggtgctggcgcatgtgaaagagctggtcgcgcagaaccacgccaaatattgcgcgctggggctggaagcggatattttcgccgccggactcaaacgtaaagagagtcagggcaaagtcgtgttcggcagcgtacagtcggtggcgcgtaatcttgacgccttccaggaggagttttcgctgttgattgtcgatgaatgccaccgcatcggtgacgatgaagacagtcagtatcagcaaatcctcactcacctgagtaaagttaatcctcacttacgtctgcttggactcaccgccacgccttttcgcctcggaaaaggctggatttatcaatttcattatcacggtatggtgcgcggcaacgacaacgctctgtttcgcgactgtatttatgaactgccgctgcgctatatgattaaacacggctatctgacgccgcctgagcggcttgatatgccagtggtccaatacgatttcagccgcctgcaggcccaaagcaatgggctgttcagcgaagccgacctgaaccgcgagctgaaaaagcagcagcggattacgccgcacatcatcagccagattatggaatttgcgcaaacgcgcaaaggcgtgatgattttcgccgccacggtcgaacatgcgaaagagattgtcggtctgcttccggcggacgacgcggcgctgattaccggcgatacgccagggcccgagcgcgacgcgctgattgataatttcaaggcgcagcgttttcgctatctggttaacgtctcggtactgaccaccggctttgacgccccacacgttgatctcatcgcgattctacgtcccacggagtcagttagtctttaccaacaaattgtcgggcgtggtctgcgccttgcgccgggaaagaccgattgcctgattcttgattacgcaggcaacccgcacgacctgtatgccccggaggtcggtagcccgaagggaaaaagcgataacgtccctgtccaggtattttgcccggcctgcggctttgccaacaccttctgggggaaaaccactgccgacggcacgctgattgaacactttggccgtcgctgccagggctggtttgaggatgacgacggccatcgcgagcagtgcgattttcgctttcgcttcaaaaactgcccgcagtgtaatgccgaaaacgatattgccgcccgacgctgccgggaatgtgacgccattctggtcgacccggacgatatgttaaaagcggcgctcaggctcaaggatgcgttagtcctgcgctgtagcggaatgacgatgcagcatgggcaggatgagaaaggcgaatggctgaaaatcacttactatgacgaggacggcgcggatgtcagtgagcgcttccgcttgcacacgcccgcccagcgtaccgctttcgaacagctatttattcgcccgcatacgcgcacgcccggcgttcctttacgctggatcacggcggcggatattgtcgcgcagcaggcgctgttgcggcatcccgattttgtggtcgcgcggatgaaaggccagtactggcaggtgcgtgaaaaagtgttcgactatgaaggccgcttccgccgggcgcacgaattacgtggttaattgtacttttcattgatgtaacggcgatttgagtatagaatcccgcccgcctttgcatacgcaaagcagatcacttacctgttgctgggtcgcctgtagcaggaattattaaagagagatttaaatgtttactatcaacgcagaagtacgtaaagagcagggtaagggtgcgagccgccgcctgcgcgccgctaacaagttcccggcaatcatctacggcggttctgaagccccgattgctatcgaactggaccacgaccaggtgatgaacatgcaagctaaagctgaattctacagcgaagttctgaccctcgttgttgacggtaaagaagtaaaagttaaagctcaggctgtacagcgtcacgcttacaaaccgaagctgactcacatcgacttcgttcgcgcgtaatcgcctggaagttgaagaaaaaccccgccccggcggggtttttttatgcgtttaattgaatttgacgacatgcagagcaacgagaacccactttgcttttctgctttcttacacctcgccacattcaattagcgcctcccctaatcgaggatctgtagtttccgccgcggtattcatacctttaagccgattgaataatgcccgttgacgaacgctggcactttccggtttccatggcaaaattcgtattggtatcgtttgcccatcattcaacgcatcaaataccttttcattggtcagtaagtcgccgcagctccatgtcttgctatcaaactgaaaatcaaataagacatggagttccagttcatctacacgcacttgacgctttgcattatcgatgcgtatttccaccttctctttatgcgtcaaagttgcatcaagattgagtccataccgtttcaactgccccttgtcgtaatagtaacgtatgctggaccaggttgatttaaaagcaaatccagtaatgaataaaccacttaacaagaacagcgggcatatgaacaagctcagtaaccagttggtgccataagtataaaacagtaccaacgagagaacggtgaacaccatgccgagcatcaacatcatcaaaaatgcgacaatgtgcgcatacaaaacctgccgaaataaactgaaattaacaggcggcctctgacgtattcctttactcactacggcgtccttttatgtcgtatgcctttatttcccgcccgacgtgcgtcgctgcaactgatcgcgcaaattcggcggcgtccctttgatagtcagggtatcggtcgccgggtcccagaaaatccgctcgcccagtagcatcgcatcaaagttaatcgttaacccgccgccgctgccggcatatttggttaactggcgtagcgtactgcgatctgccgggaagctctcttccagctcatagcctttttcggcggtaaattcgctgaagctgacttcactgacgccggaaagctctttagacagcgattccagctcaatttcttccccggcttgtaattgctcattgcagtagctgtacacctgctggcgcacgttctgacgttccgctttatccaactgcgcttctgcggtgaaatcatccactgcctgcaacaggccgcgattctgcgctttggcgttcaacccttcgctggcgccgaggaaatccataaagaagtcagcgaccttgcgccctacccgacctttgagaaacgtcagatagcgggtcgattgcggattagtttcccactcggtaagatcgatacgcgccacgatatccgcatggttgatatcaagataatgcgtcgggttaatgtccagattttcattgacccgcatactactcaggttgttcagtaccgtaaccagcagatactccaccgccaggtaacgataatggcagaacaatacaatgccgccgtccgcaaagggatatttcgccagttcgtcacgcaggcgtccggtcgccgcccggctaaaggcaagaaaatcttcttccccctgacgttgcaaccgcagcgcttgcgccagttcactctcttcattaaacaggccatacgccttattcttggcgctatagacccgatgcagttcagccaccatctcgacaacggtggttgtcggctccagcaatgaatcgcgcaagaccagctcaagattttgctcatcgcgcttgataagctggtgcagggcaatctggttgatatccagactcatgataaactctcctttaagaccgggcggtattcaaccaccgcctgccggaagacgcaagcaatcgccctgtcatttcaggcgttatccgtaacgcgaatgatttaggggataaaaatgcagaaaaaaaactgttgctacggtaatatgttgccctttcatgaacaaacagattttgatttatgccacaactctcccgctatagtgatgaacatgttgaacaactgctgagcgaactgctcagtgtactggaaaaacataaggcgccgaccgatctttccctgatggtgctgggaaatatggtcaccaaccttatcaacaccagcgttgcgccggctcaacgccaggcgattgcgaactcttttgcccgcgccttgcagtcttcgattagcgaagacaacgcgcactaaaaagccgactccggagaaacaagcgacaggtatggtaactcatcgtcagcgctaccgtgaaaaagtctcccagatggttagctgggggcactggttcgctctgttcaatatactgttggctacgttgctcggcagccgttacctgtttgtcgccgactggccgacaacgcttgcgggtcgcatatactcctacctgagcattgtcgggcactttagctttctggtgttcgccacctatttgcttattctttttccgctcacgtttatcgtgatgtcccagcggctgatgcggtttttatcagccattctggcgaccgcgggtatgacgttgttgcttatcgacagcgaagtctttacccgtttccacctgcatcttaatcccattgtctgggagctggtcatcaaccctgaccagaacgaaatggcgcgcgactggcagcttatgtttattagcgtgccggttatcttattgattgagatgctatttgcgacatggagttggcaaaagctgcgcagtctcacgcgccgccgccatttcgcaaggccgcttgcggcattctttttcgtctcctttatcgcatcgcatcttatctacatctgggcagacgctaatttttaccggccgattaccatgcagcgggcaaacctgccgctctcttatccgatgacggcgcgacgttttcttgaaaaacacggtctgctggatgcgcaggaatatcagcgccgtctggtagagcaaggcaatccggaagcggtctccgttcagtacccgctcagcaatttgcactatcgcgatatgggcaccggtcagaatgtgctgctcattaccgtagacggcctgaactattctcgctttgagaagcagatgccggagctggctacatttgccgagcaaaacatcgacttcacccgtcatatgagttcagggaataccactgataacggtattttcggcctgttctatggcatatcgccaggctatatggatggcgtgttatccaccagaacgcctgcggcgctcattaccgcgttgaatcagcaaggctaccaactgggactgttttcttcggatggcttcgccagcccgctttatcgtcaggcattactgtccgatttctcgatgccggcagcgcaaacgcagtctgatgcgcaaacggccagccagtggatagactggcttgggcgctacgcacaggaagataaccgctggttctcatggatatcgtttaacggtactaatattgatgacagtaaccagaaaaattttgttaagcgttacgccagtgccgccagcgacgtggatgcgcaaatcaatcgggttctgaacgcgctgcgagaggccggtaaattcgacaatactgtcgtgatcattaccgcaggacgcggcataccgttgacgccggaagaaaatcgcttcgactggtcgcaaggtcatctgcaagtaccgctggtgatccactggccggggacgcctgcgcagcgtattaatgtgcttaccgatcataccgatgtgatgaccacgttgatgcaacgcctgttacatgtcagcacgccagcgaacgaatattcacagggccaggacatctttaccgttccacgtcgtcataactgggtaacggcggcagacggcagtacgctggcaatcacgacgccgcaaatgaccctggtgctcaataataacggtcattatcagacctatgacttacacggcgagaagatcaaagatcagaagccgcagctcagtctgctgctgcaagtgctaacagaagagaaacgttttatcgctaactgattaattataaatcagttagcaccgtttccccttgcattcgcgttggaaagaggtagtattagcacccacaagtcggcacgtagcgcagcctggtagcgcaccgtcatggggtgtcgggggtcggaggttcaaatcctctcgtgccgaccaaaattcctcgaagaaccagcctgttacggctggtttttttatgcctgttttctgaacggggaagcaacggggaataatcggggaaaaaccccgacacaaaacatcgactttaccgtaaagtttcaactattcacatcaccgggcagtcatcaaactccgcgttcctggcatcattaatgatgtacgtgataactccaaatattgcgtgtgaagaattgtagccatcaccatcttctggcagcgcttcctttctcccgttctccagatttatcaggtggggctgagggtgagttcggtatcgcttgatcctgaattccccatctatcgcgcatatcagcagcgagccatcacaggctgaaagcgacgcgtccacaacaagtagcgccccctggattatcccttccctgaaatgtgaacgcgatgcccgcatgaaataagtcgctgcgggctggctgattagctgctgatcgagggagatccttgtttcaacgtaatcactggcaggtgaagggaagcccatggctatagtcctccgtttggattgaacagctgaaaggtacgtctccccttcctgcgttgatacatcgcggaatgttgtcacataccactcgatccattcgttagcctgcttcatcgtccagttccagttaaccttgctcagttgctggacaaaccgctgtgtggtgacggtcttccggccattaggttcctgctgtatcgaagcataccaggctatttcaatattgatggtttgcccggagcaaaagatatcattctgggagaattgactaagagggttcaccggatcttccccgatgctgatgttcgggttaaaccgatgatgacactaccggcgatcaatactgacgccagcaagcatgagaaggaacagataagccgtactgttcaggaaatgtttgaagaggctgaattctggttagtgagcgagtaaagtttttcaatatccgccatagttacgttttgatcgcgctgtggcggattttcattttcgtaaacgttcccttttcccattctcaaaatttacagggtgcgattgcgaatgtgtccggtaccgcttaatcctgaactcctctccatctatgcaaaccagcaatgagtcgtcgcgtggcgaaacggacgtatcaataaccagcaagatgcgctggtcagtgaccttctttgatgtagttgatgtagttgatgtaacaggtcaattttaggtgacgacttttataaaaaagtctatcatccattatcttaatttcgtcttgtgtggcaccttggaattataggtaaaaaatgatctacaagaaattcagactcgatataaatgggctaagagcttttgcattgataagtgttgtgctgtatcacttcggtgtaccttatgtgtcaggtggctttataggtgtagatgttttctttgtaatttctggttttcttatgactggaattgtccttgaacgcgtagaccacaaaggagtacttgatttttatattgcaagattcctaagaattgtaccagctctggtatttgcaattctcttgttgatgattttcggtttatttacactaagtacaaatgaatacgaagcacttagcaagaacgcaatatcgtctttacttttttattcaaataattattacgcaattcactctagttatttcgactcatcatcagagttcaactttttgcttcacacctggtcactatcagttgagtggcaattttatattttatatcctttattagtcattatagttaaaaaattacggtttcctgttggactctcattatctgtaattttagccatgtcacttgcaattacacttatgcgagtgactggaaccaaagaagatattttctatcttatccctaccagggcatgggaaatgctggctggcggccttgtatacatagcatctgtacgttacaaaatgccagaatggataaagcattgtgaggtttatgggatagtcctcattgttgttgctgttgttatactgcacagtaatggttactggccaagctattcagcactcgctcccgtgctgggtgcttcgatggttattctggctaacaaacagaactctttattcacatcaaacagaattgcacagtgggtgggtaagatttcttactcagtttatttatggcactggcctgtaattgtagcgatgaaacattatgatattgagttcagcgctataaatattttctttggtgtaattgtgtcttttgcgcttggggatatttcatacagaacaattgaaaacacgctcaggaaacgagttaagctacaatttaatattgtattattttcctctactctggctctatgcttgtttgtcatgttcacaaaaggtgttagttttagattttcagacaccctaaagcaagtcgttgagtatcgtatggacaactctccctggaggcctgatatttgcttcctcaatccagatcaagattattcagcattctcaaaatgtcaggataaaatgactgaaaagtcttttgttgtatggggtgactcgcatgccgcacatcttatgccagggctgaaatcggtatttggaaattcacttaacattacgcagagaactgcaagcttgtgcccaccaatcattgggcttcaaaaagatgacaggccgtattgcaaagacatcaatgatatggtagccaaggaaatttcagacaacaagcctactacggtattaatgtccgcgttgtggcctgtctatcctatgcgtgattatctgcctgagactattaaattcctgaaggataacaaagtaaaaaacatcatcattgttggcccgttcccggtttggaagaaaacgatgattgatactattgaggatatggggattaattccggaaggaccgttccatggagcatgacggatgaaacccgtaatctgagagataatgacaaatatcttagagagctggcgaaagagcattcccttacttatatttcaccacttgagactatgtgtacagaaagttattgcaaagcaataatagggaatagaattgcttaccctatacaatatgacaatgcgcacctaacaccagaaggctcagggtggtttattgaggaagtgaaaaagcagatttcaaaataaacagaggggcttgcccctctttttattttataaaactacaacaataatgcaaattattttatgtgtatagcttttctgatggggcatgctatattttgtgcaaccgatgtatcaaccgctttcagcgcatcgagataatccagccacagattgtactgcgccagttcgtcgcccgtcaggcgcccgagcgccgctttgcccggccaccgcctgctgttcatgtgctcgttggcctgatcgattctcttcttcttttcctgatttgcggcagaaattaaatcatcttgcgttggaggtggaatacaaacccaggcaatacgtccatttgatgaaccgagatacattccctttggtggagttttcatataatacttatcaacttcttcatcggtcagagcataaaaatcattcgaccacaacccactggccttataagctggaatgttctcctctgaaaaatatgtgtttgatgtcgaggaaaaacatattatgctcatgtcaataccccatgtaaattacagatatggaattatcgccaccggatggattaaatatacgaatagcaccgttgttctcaatcaaatatgttggggatatcgtaatatcaccttgtgcatcctgaggggtaagcgtggcagccttgaatacataaggaaatgttgttggtaatggaaaaacataccctgaagggctattcccgggaacaaagcaatttaaagcctgaaagattgcgccaccgggcagagaggtatagatcccggcagggttgtccctgagaacaaatgaagaaatgtccgggttctgattcgcgccgttgcccacgtcccgttgtgcggccgatttcaattgaacgtttcgagcacatgatttttatctatttattcagatattccggccagttaatatcaggtgcaacatctagcgccagtcggcgcagctttgttcggtattcacgtagcgcagtgagttcggacaattcagcagccgttatatcgccatcgtcctgagcttctacaagctgattgatttttgctgtgaccgacgtcatacgcctgtcgcgctctgccgtagctaaagcaacataatcaatctgaacaggggcaataacgccgttgctgtaggtaaaattcccaggctgaaaaccatcgggaatatcagtatcagcgaattccacaacagagcaattcagcggaaatagcttagtcgcatctttatccgcagcaataatcagccctgttttgtcatactggattttcagcgtatcgggctggaataacttctgtaacacataccagtcaacacctgattcatcctggataaactgaatactgcaattctctgataatttctgctgaacaagggttaattccgttgttttagtgaaatttttaaaatgcctcatttttatgctcccaccgtataccactggccattcactttaagctgtaacaggcgtcgttggatcctgtctggtgtatcgttcgagtctccattctcaacacctgtaatgacgtaacctaactggtctgcaaatccgggcgaacgatataagtttccatgctcaacggcaccgaatcgaattgactgaacatacccactcagcatgtcagttgtagcaaggaatacaccagacccatcatcatgaagcataaatggctttgttttgtcgttctggtacacaccaaccatggtgatgtactgacgcgctggcttagaagccacaaacgcgctcagccagcccggtccgctaccaccgccccatatatcaccgtatacatcgccatttttgttgaatatcgcacttccagcctgcaagttttcagcagctgcgataacaccgagtcgggtgctgatatatgcccggatagccaggtcttctgagttctgaaatccgataccattccatgacttaatgttcagattgttaccattaaaacctgcaccatcaacgtcacctttagccatcccaccagtgccatccccaaccgtaaccagggtatcgccacgcatatttggtgcagaaataccccccgtaaaggcgcccccctccagcatcgccacttgacgccatgaggtaatacccgttcctgttccgtgaccaaacaatacgttattgccactgactgcaagaacatccacaacagtggtcggacttaccacctcgctaagggtaataatttgccagaaacttacctggtctggcgcgtcgggggcctgatgcgcacgcataaactgacagcctgtagccgcacgcgcgccgattgatgttcggtcaattgcgtcactgacaaacgttcccgcgaggaatcgcccgtcacctttaaaaagaacgtctactaaaccaacgttctggagaaacagcggcttattcgggatgtccgcgccattctgatttttttcaagacgggttttaacctgttcatagatcaacctgccaatggcggcgtgaagctgcgtatgttcgcctttactgagtggtatgccggcggcttcaataacagtacagacctcttcctggactgcatcccacatatcactgttgagatccgttgcgcggcggcccgtggcgggatcaccattcgtaaatccgtttttcccctgaccaaatttatctttttgcgcagtgggcgtatcaattctgtgcattctcttttccttccggataagcaaaaacaacaaccgtatgtgacggacaaagcttatcaatcacacattcagcaacagtatcgccccacgttctgatcgcagaatcgcaggtgcttgtacaggtctgccatccagcagacgggaaaaacgggtaatctcacgaatcaccacaccatcctcgtcctggtaccattcctctccgtcgcgggcgacgcgaaatgcaaaagaggactggttgatatccccgcgctgcattggtgccaacaccagatcacggattgtctgagtttctggcgcggtgatgtcataacgcagcccccgctcatcaaccgtcagtgccagcgtgcccgcacttctgcgacccaggataaaattggggtcatggttgaacaacgcccgtacatcgtcattcagcacttcatcaaacgcaccgggccggatgatttcgcgaaacgaaccgaaaatcagttcagaacgactgtcaaagaccgaaccatacccgatgatccggctgggctcgctgtcgtgcgtttctgcgcgcacctcgccgctgtaacagcgaatttcacgttcactcatcttgagtgttctcctagattgtggttttggctggccgggaggcgttgacgctgaccagcatttcatcaaggccgtctttcggattcatgtcctcaaacgcgcgtgcttcgttgcggctcatccatccgacatactcaagagcagatgcaaaggtcagtgtcagagcgccacagagcaaaatctcgagcatttttcgcttccagccgccaccactgccaaaataggcgatgcgcaaaccagccataacaatcgacataatgactgcgcccagcggtgtgtctccacgccaccagctctgtaacaattcaagtaaatcaggccaggtatttgggttatgaggcatttgtagttatctctcacctcgctgatacagcaggtgcaaattgagggaataccacgtaccgcaaatcagaagcggaaacgtaaaagaagccgagccaatcgataactgcgggataggccaggcccaacgaatcccaggcccagaaacgacaaaacccgctcgacggcgggtttaagctgcgtggcaaagtaaccactcttagcagattacaagaatttttgcggaccgcgttaatgatttttaatcccaaagtcgtattatgcgttttttactgtaggagttaacaggcttatattatgttagaaacactatcattcactgaacgtgacgagttccaacgaagaaacatcgctgaaaatatcatcaaattgctaaaaccagaggcagacatttcaccactggtaatagacggtgcatgggggacagggaaatcagaatttagtatcaaactgaagaatctcattatcgagcaagaaactgagtctaaagttgtctatgttgatgcctttaaaggggatcatgcagaatctccattacttctaataacatcagctattgcgagcattttgccggaggaggaaaaacaaaacttcattaagagatctcttcctgcaattcgatttggtttaaaaactgtactaaaagctggtgcaggttggtttttacgacaggaggctagtgaagttgccgaagaattccaagatgcgatgaagaaagcaagcaatgcagcaatagatgggactattgaaaatatacttgaagaccacatggaatcagagaaaaacataaactctctaaaatcttgcattgaagatatatcaaacaagcaaaagatagtgataattattgatgaattagaccgatgtaagccaagtttttcaacaaatatcattgaaacaataaaacacatctttgatatcaataacgtattttttattttagttacaaacactgaacaactaaaagcatctataaatcatatttatggttatagcattaactcacaaaagtatcttgacaagtttataaaatataccattactcttccagacacatgcttaataaatgggcataacgtatgtaaaacctcggttatatattgggatcaccttgtaggtgaaactacattactaaataaaatcaacagcttagttggtagctttatttgtgatttaattcaacgaaccaacttatccttacgtgaaacacaaaccttttcacgcaatcttaacattttccgactgttaaacgacaatgagtgcaaaagcaatgatccttttataaatatgatcgttgtcgtagctgtcttcatacattgttttggtgacaaggaaaaactaaaacaagaaattaccgctgaatctatatcttatttagcagacctgcttaacataaaagaaataccttattcttatgagagaagatcgcaaatccctgaaatatcaattatattcttcggaataattaaagacagcattactcttaatgagcgatttgcccctaaaagtgatgaggaacttaaaaagttcacaaatgtttatactgattatgaacacctaaaattttggagcactactcccagagagttaatgataaaatatattaatcaaatgtcattcatccagtaaataatacgcccctgcatggggcgtattattaaacgtccatatctaatgttagatccagcattgaaaggcagccatcaataaatccttcggctaactgtatttctatacgtaccaatttctcatccttcccacgcacctttgcaatcttacgcttggatattctgtataaataatgtgccacaagaagcgaatgctcatcaggccttttttgctttaaacgagcaagacacccctcaacaattaatgcgtcattatcagaacaagccacacgtgtcttgcaggtatagggaagaagccctttaaacccagcagctataggcgaatagtccactcctgagctatcactcgccgcccatgccccccaacgctcaagaaccatctgaatatcacgcatcaactttctccaccaaatcaggccagcacgccaattgccagcgcgcgatcgataaaacgaaatatcaactccagttgagagccgtatttctcttcgaatgccacggtgtccgcatgtaactcattgtgatgcgttctgcacaacggcagcacaaagaggtcatgcgcctttgttcccatccctccctgaccgtagcctatcaggtggtgcggatcatccgcctgcttcccgcagcaggtgcacggctgggatttaacccagcgggtatatctctcattgacccatcgacggcgtttcggacgtaacatgaagctttccggcgattccggatcaaccctgagcgccagtacctttttcgccttatcctgtacaatgctggtggccagcaccgagggaacaatttcactttcacgggtagctgactggacaattgccttcggcatccttaatgcttttctcgcagcgctctccggtaagacttctgccaggttattgcgtaccatccaccagcacagttccgggagagtaactgcgtgcatatcgtcaaaacccagatcacgacaaacaaccgataaaacccattttgtcgtgttctccacagctattgatttcagccgttccgtaaactgttcgcgcagcaggttatcgcagtgccagcacagtcggattgcccccggagcgtggcgcatggttgtcatctgttcgctgtgccagtctgaatgcggccactgacagccattcccccggagtagccagctttccagactatccagaccaccagcacgatagataaccgactcattacagaacacatcacgaacagcaggatcatccgccagcggctgtgataccgccgggaccgcgccgctggcgaaagatgaaaattgctccggctctggttcaagcagaacacgcccctgcataaacaggggcatcagttccgatcccggcctgaacaatacaacgcccatacgaggagcaatttcaggggtcagtaacgctctcacgatcacctcaatgaacggtatcgagcagcttcagcagctcagggaatttggactcgaagaaatgcggctgcgtctcgcgagggtttgccgggctggtgatgtttttgccgaacatgcagccttttgccgtcagcgaccagaattttttaatgccgttaatcgcggagcgactgtaacgctcacgatgttcaacaacacccagctttgctaactgctgatacgcctgattagccgtcatccggatatttcacctgtacatcatccgtactgtctgatgttgttcgtccgggaatatctttgtcgcaccgcacctcattcacctggtgcatcagttacgacgccactgaacgttcagatagctccccagcatctcctccacaagaggtcgcaggccatccaaaaatgtctttttcgcgctctccatcgctcttgctccgatagtgcgctctgcatcggtattaccgaccagcccagacggtctcagctctgtgtcagacagcatccggtacgtttcctcataatccgatatttgcttttcacgaagcgcgttaacgcgttccggcgctttgcgctccagcactctgtgtaacggcccccactgcagtatccactccctgaactcgcttttttcagcggctttcacctgaagctccgcgtcctgaaggtctgtaaccgtcacgccggatacgtcaaagaaacgcatttctgacgtcacgctggtcagcccgagtgatttcttcagcttattctgatacgccagccagacctcaatttcatcaacgagagccagcgttctgaccttttcccgggcaatctgttccagttttcccagacggaacatctcacgccccgtggcaaccagcgccgcgagatcgttatcgtattgccctttttctgcattatgtaccagctgtacgttcttcatctggtgcaaaaaaaatgtgacccggtcctcgcagcttgaggttgcctctgttgccatagcaaaggtgtttgctcttaacgcctcatcttcagccagttgtgccagccaggacgatatctgtgccttaaaccccgcgtcctttatgaagttttccgtctcactcagtctgtccaggaagaggctgaatgcgtcggcgttatcttcctgtccgaacatatgccatctgtctgcaggagccggttccccctcccgggcaggcaccagccagtcagcggccgccaggtgcagtgcccgagtttcccggggggcggaggctcccgccatatcgaatcgtattatggggcctgaatagccaggcgcgctggtgatctcccgcagcgcctgcaaagtacgttcagacagtgggttcccttccagatttacggttgtctctgaagacagatgaatgagactttccggcaggcgggtcagctggttacgatagaccgacagcgacagtagtcctgacggcagcatcggcaggctggtcagccggttaccagataccatcagctccttcagttctgacggcagcaccggcagactggtcagccggttaccagatacaatcagctccttcagtcctgacggcaacgccggcaggctggtcagccgattattataggcccacagcttatataattctgacggcagcgtcggcaggctggccagttggttatcagataccgacagctcctgtagccctgacggcaacatcggcaggctggtcagctggttattataggcccacagcttacataattctgacggcagcgccggcaggctggccagttggttatcagataccgacagctcctgtagccctggcggcaacaccggcaggctggtcagttgattaccaaagatccacagcttacatagtcctgacggcagcgccggcaggtgggtcagcgggttactaaagatcgacagttccagtagtcctggcggcagcaccggcaggctagtcagctggttaccagagacctccagcgtccgcagttctggcggcagcgccggcaggctggtcagattattatcaggaataaccagtgtggtaatatgcgcgggtaaacagtctggcaaggtggtaagacctgattctcccacgttaagcactgcattgccattattcaggcaggcacgcattttctgtaccactgctgcacggccgcgtgactcttctgcgggtgcagcccttctccacgctgaccagacagcatcatactctgctggcgtctgtggagccgttgtggcagggaggaaggatgtcctgaatgtcccggatgccccttccgcgtgtcctgtgccctcctcaccctgtgctgtgtccagggtgaggcgatgtgtttcactgtacccctggcaatttacggtatagttcccggcatcatcaagggtgactgacaatatctcctgactgtcttcatccagaatacagaagtaattttccccgtgctggccggaatgaatgctttcctcccatccggcatacgcgagcgtcctgagcagttcaaatctgttgatcacatcctcccgcgtcgttccggccggcgggtgacaaatcgtccagatgcactccagcgcttcagtctggtgcgttgagcaaaaaaattccttcattttttcccaggaactcatttcagggggggtatcagaccaggcaatacgataaatgcggcgattactgatggtggcgggaagacatccgcttccaatatgaaagggcataacaaaaaacctttataaatttacatatagtatctgtccggcagacatcatctcttcctggtcttaatttcacaataaggttatcggcggattcatggtcgtcctgacatggcgggcttcagaaggtgcagaagaaaaatccgttatgatgaccggatggcgggactgtcattttacagctaaagtgtcgattttttcagggtcgctttccacgatgaccagatcatccggtatcaacgcccgggcgttcaattttcgattctgcctgcctgcgcagctcttccggcgaataaaccctttgaacgactttaccgtctttaaactgccagcagcatgaatatcagcgcgacggttttcatccgtatcaggcaactctgcaacgctctggccagcaggccacagcccggaaacatcacgcgtaatacacgtaataacatcgttatcgtcgtaggtaattttcagcgtgtctgctgaaaataattgctggcacccataccagtcctgaccatcctctgatttaagatacgccgcatcggcgaataatgtgtcatctggttccggtgcatacggaatgaaatttttaatatttaaaaactgtttgttctttttattttttttccgctgtcataattattccttcttatacacttggggctgtcacccacgtatcaccaaccagatactgaatgggacgttgtcacccgaatagtcatcgcgccacgcactcccattacctcaatcactgcgccagcgagacagatattaccgcagccagtatccgtgatgattttgttataagcgtaagaccaagagccacgacacatccagtaagggtgattgaatgcgccctgagactccagccagacgataaactccgccgtcgtccacggattatcatcacagccgataataactgcgccatcaaacgctcgcgcggcaccgatacgacgcacaaacaaatccttgtccggaatatcgccgccattctgtgatttttgtaatgcatcggcggcacgacttatggtttctcgcaaaccaacgtattcgataagaccgtcaacactttttcctgacagcgccgtcagggtttcgtccagcggctgcttgcccgccagtttattcagtaccgtggtggcaaagttcggatcatttcccaacgcgtcagccagttcctgcagggtgtccagtggctccagtacggaaccaaccagcgcggcaatcagtttgcggacaaactccgcgtttgttgtctgaagccctttagcatcgcctggcggcgtcggtgtggtcggcgttccagtgaatgccgggctgtccagcggcgctttggtccgtacctcacccataacggtttttaccgcctttggtgtggccgccagcgcttcgctgtcactgtccgtggcactgcttaatttaacgataccttttttcgtcaggcttgcatcttccagggaaatcacgtctgcgatatcctcggcccgtttcgcggcctcttcggctcaggttgccaattctccggctgcagctctgctttgcgctgccagtgatgcgctggtatcagatgcggcggcgtgggtggatgcctccgatgctgatgactaggcggctgccgccgttctggctgtgtcagccgacgccgcgctggctgatgcctccccggcttttgtggtcgccgtacctgcgctgctctccgcagatgctgcggatgaagctgccgaccaaaattccccttgaaaaccagcctgtcagggctggtttttttatgcctacaattaaaaagttagctgatgccagagacgttattttgcatgaactgattttgcatgaactgattggacatctttcctgtgcagtggtcacagtaaagtcaatgcaggcaactaacgtaaaccatgtttgtactaaaacagaaaaagcgcatctacaccctatactggaaaaaatgtttgcagtggcaggtaaatgagtaagcaatctgtcgcagcaataataaaacgttctggtaaggtaaacggcctaccacgcctttgtcgctaacaattagcctccctgtcgccatagggtcgataacgatcggctattcacaacacgttttgtagacaacgtacggtgattaattactccttcagccagcaactcgctaattgttattcaacttcagaaattataactaattgaagcacctacaaaattatgccctgaatttttatccgtaagtgatccattcgagaaatgccggatataagcttctgtagaaaaagccccaaagttccagccaagaaacgctttttctccaaaggtaaatgcagaattgacacgcatatcatctcgcgacttagattttatataagcccccagaccaataccggtatagataccagcgaaatgaaccagcgccacatccttcgagatacccaatacgccctggttatatttattacagggaacgctgccagaatgtttactgcaatcatcgctacccttagccttaaatcctcctaactccagattatttcttgcctgtaaaaagaaaaaatcgctgggttcactgtatgtcagaaaagccgtatataagtgctcaacccctcctcttcttatactttctcccgcagcaaaagagatctgatgcttgttgcccttgccaaaaaaaacattatcattagcagaacatgcgaatgcacaaggtaataatagatatataaatattctcttcatatacactccaccaccatttcaatgtcaatagttatttttaaccggctaacatatttaaaattttctacgccacgcttacgctcacagaaacggctgatatagcatccacactacgttctccccttgagtcgccccaacgggtgctcaaaacgccgcgagtgttgttcaggcacatccaggataagttataagtgaatgacactcatttctgaccacattttcatttatgataagaatatcgtcagaatctctttatcgcataaaaatacctctgctattgacttaatatttaatttaacagatgtcgcggtttattcgttctgctcagatgtatttcattgacattaataaaaccataaataaattcagttaaaataatttgttaataatgacaagctttagacgctatgacttttaataagaaatttcctgccagtaaagatagtctggacttacgggtgcaagggcgcagcaacatatgccacacttctgttatgtcacattgtccgaaaaaagcgtccagaccagtattcaacttcagggagtattctgttttctctcacaacgggttgttttatcctttctatcgttcagctaattactcgcctgtcacaggttttactacttacccatgcactaattagggtaaaatttacgcgcttgacaatgtggcaaatctggacgatttccgcgctgaaaacaataatcattctaataaaactcaggagatacagcatgcctgaagtaacaccttttcaggtgcttattgtggacgaccatccacttatgcggcgaggtattcgtcaattactggaactggacccggcttttcatgtcgttgccgaagcgggtgacggggcgagtgcgatcgatctggcgaatcgcattgagcccgatctgatcctgctggatctgaatatgaaaggtctgagcgggttagataccctgaacgcgctacgccgggatggtgtgacggcgcaaattattattcttaccgtctcggattccgccagcgacatctacgcgctgatcgacgccggcgccgacggttatctgctcaaagatagcgatccggaagtgctgctggaggccattcgcaaaggcgctaacggcggtaaagtctttagcgatcgggtcaatgaatatctgcgtgagcgcgaacggtttggcgcgcaggaagatccctttagtatcctgaccgaacgagagttagatgtcttgcatgagctggcgcaggggctttctaacaaacaaattgcgtcagtactgaatatttctgagcagacggttaaggtgcacattcgtaatctacttcgcaagctaaacgtgcgctcgcgcgtcgcggcgaccattctatttttacaaacacgcggaatgcagtaacaagccaggcccggtggcgccgcgccaccgggccgtcagggtcttatttctcctgcgccagccggatactgcgctctatcaccgcccgccgggcgtcacccgccggcagtaacttcagcatcatctcccaggccgccaccgcctcgccaaagcgctgctgctcaaaggcgctgaacgcatacaggcttaacacccggatatccgtgtggtcgcggctcaccagctgacgcagcagctccccgccgcggcggttatcctccgggtcggacgagcgcgtcagcgcctccgcgtagcccagcgccgcatcgcggtttttcgggtccagacggtaagcgtttgcataggccccggtggcggtaccggcattacccagtaccataccggtgcgccccagcatgagccagccctcaacattgccggcatcattctgcaggcgggtgcgcagccccagcgccagccgcgccatctcctcctcattcagcggctgcgcctgcgggtccagcgcccgcgccagcagtcccggcgtctgcgccgttgcctgctgccaggccctcacctgcggatagctgccggtctgtgagtaactgatggcggccacgaccagcgccataaccacgcccggcacgtaagcaccccacccggcgcgcggtcccgccgcaggaatggcgtcggccaggacgtcctgtctgatacgcacccgccggcgcgtgcgggcgacgattatccacccgcccgccacgatggtggccagcggcagcacccacagcagcaccgtcagcggggtcagcggcgggtcgtaggtgacgaagttgccgtagcgcgccaccatgtaatcgatgatttcctggcggctcttcccctcctgcatcaggtcatacaccctgcggcgcatgtcggtggctatcatcgcgttcgagtccgcaatgctgttgttctggcatttcgggcagcgcagctgctccgtgagctggcggaactgctgctcctgcgcttcatctttaaacggcatcacgtcggtggtcgcccgcgctgacccggcgataaccagcaccagcatcagcatcaccatgcccggtaacagtctcattgcgccgcctcccggctgtatctgtcccacagcggtttcagttcactttcccatacccgggcattcaaatcgcccgcatggcggtagcggataatccccctgccgtcgatgaggaaggtttccggcgcgccgtacacgcccaggtccagccccagcatcccgtcgctgtccgataaactcagcgcatacgggttgcccagttcctttaaccaggccaccgccttcgcccggtcgtccttatagttcagccccaccacccggataccctgcgcagaaagctggttcaggtactgatgctcggcgcggcaggtcgggcaccaggtggcccagacgttaagcagcaccggtttcccctgcgtcagcacctccgcctgatagtactgacccggcgtctccagcgattccaggcggaacgccggcaccggctttccggtcagtgccgattcgagattcgtcgggtcatccccctgcgcgttgcgcgccagctgccacagcagcgccgcggcaatcagcagaaaaatcagcagcggtaataacagtacgttgcgtttcatccggcctccggcaatggtttacggcggcggtagcgcgggtccgccaggcacagcagcccgcccagcgccatcagcagtcccccggcccatatccagcggacaaacggtttgtagtacaggcgcacggcccacgcgccgttgtccagctcctccccgagcgcggcgtacaggtcgcgggtcagcccgccgtcaatcgccgcctcggtcatcaccatccggctggtgttgtagagccgtttctccgcgtgcagcaccgcctccggctcgccgtggcgcgtcaccccgatgagggccaccccgccgcggtagttgggcccggtgatgtcccgcacctcccggaaggtgaagcggtagtcgtgaatggtcacgctgtcgcccgcccgcatccgcacgtcacgctccacgctgtaattctggctgaaggcgatgccggtaatcgtcaccgccagcccgaggtgcgccgccaccattccccagtagctgagagaggttttcgtgccgcgggacacgcgctgtacggcttcggccaccgccagcaccgcaatccagcaggccatcgccatccccaccgccgtcatggcgatgattttatcttccagcagccatggcaaaagtaccgacagcaccagggtggagaccagggcggtgagcagcagcgtcctgatgttacgcggccggtcccggccccagcgcaccagcggccccacccccagcagcagggcaaaggggaccatcagccaggtgaacatggtgttaaagaacggctcccccaccgaaatgctgcccagccccagctgtttgtgcaccagcggcagcagggtgcccagcagcaccaccagcatggcggccatcagcaggacgttgttgccgagcagcagcgactcgcgcgaccacagcgcgttgttcacccgcgaacgcaccctgtgcccgcgcacggcgaacagcagcagcgagccgccggtgaccagcaccataaaggcgaggataaacatcccgcgcgccgggtcggaggcgaaggcgtgcaccgacaccagcaccccggagcgcaccaggaaggtgcccagcaggcacagcgagaaggcgcagatggacagcagcagcgtccacgccttaaagccggcgcgctgttcggtgaccgccagcgagtgcagcagggcggtgcccgccagccacggcataaaggaggcgttctccaccgggtcccagaaccaccagccgccccagcccagctcgtagtaggcccacgccgagccgagcacgatgcccagcgtcaggaacacccacgccgccagcgtccacgggcgggcaaaacgggtgaacgcgctgtccagacgcccgctcagcagcgcggcgatggcgaaggcgaaggccaccgagaagccgacatagcccatgtacagcagcggcgggtggaaaatcagccccgggtcctgcagcagcgggttcaggtcgcgcccctccaccggaaaggccggcagcgtgcgggcgaacgggccggaggtgaacaggatgaacgccagaaaaccggcgcagaccatccccatcaccgccagcacccgggcgacgatatccgccggcacctgccggctgaacaccgccaccgccagggtccagccgctcatcagcagcacccacagcagcagcgagccctcgtgcgccccccaggtggcggccacccggtaccacaccggcagctgcgtgttcgagttgccggcgacataggccacggtgaagtcgttaaccacaaaggcgtgcaccagcacgaaaaacgcgcccgccacgcagataaacagcagccaggcgaacaccccggccgacgccatcatccgcgcgtcaccgcgcgccacgccccacagcgggtaaacggacagcagcagcgccacgccgagcgccaggcacagcagcgcgtggccgtattcaggcatcatgatgaggtgtccttatcagcgcgttgcgggcggcggtggttttcctgcatcgccttttccacttccggcggggtgtagttctcgtcatgtttggccagcacctcgtgcgccaggacgtggttgcccttctccagggtgccctgcaccaccaccccctgcccctcgcggaacaggtccggcagtatcccctcatagctcaccgtcaccgacccttcggcgtcgtagagactgaagttcaccttcagcgagtccgggtcgcgcctgacactgccgggcatcaccatcccgccgacgcgcaggcgctggcccgccgccggcagctgctgcgtctcgcgcttgccgtagaggatttcgccgggggtatagaacaggtcgatattcgcgcgcagcgcgtacaggaccagggcggtggtcagccccaggcccgccagcaccgcgcagaccacccatagccggtttttacgtcgcaggttcacgcggcctcctgttgcgcctgtgcggcacgcatccgcgcctcgcgcgcccgctgctgcgccacgccgcgcagaatggcccggcgctgcagcaccgtgtgcagcgccagcagcgccagcggcgccacggtcatcgccaccgccagccagacaaaaaaggcgtacccgcccatggcgaaaaaatcgctccacgatgaaaatgccggactcaccggtgcccccttttcagtatcagttcgctcacccacgggcggcgtttttccatcagtaaaatcaggttgcgcatccgcatcagcgaaagcgtcataaagagcagcaggtagccggcgatggcccagcgcagcggcgagcgcatcgccgggtcgatactctgctgcatccgcgtcgagccctggtgcagggtgttccaccactcgacggaatagtggataaccggcaggttcaccacgccgaccagcaccagaatgcccgccgcgcgcccggccattttacggtcgtcaaaggcgtgccacagggcgatgaccccggcgtagagaaacagcagcaccagctccgaggtcaggcgcgcgtcccacacccaccaggtgccccacatcggtttgccccacgccgcgccggtgaccagcgcgatgaaggtgtacaccgcccccaccggcgccatcgccgcgacggcaaggctggccattttcatctgccagaccagcccggtgaacgccgccaccgccatcgccgcatagatacccatcgaccagatggccgccgggacatgcaggtacataatgcggtagccctccccctgctggtagtccgccggggcgaaaccaaagccccggacccagcccgtggccagcacaatgatgccggccgccgccagccacggcacgagcctgccgcaaatctgatacagccggggcggcgccgccagctgatgaagggttttccacatagtcgtcacctgacctcctgaaaccagtaaaatgtccgtcgcgccggggcgctactgcacgctgaggcgcagcgccgccgcggtggcgaacgggcttaacgtcgcgctgcccgccagcagcgctcccagcaccgccagatagccgtcagcgggtaaatgcatcgatgccgcgtccatcgccgcggcggcgaaaatcagcaccgggacactcagcggcagcaccagaatgcccagcaggacgccgccgcgccgcagcccggccgtcagcgcaacgcccggcgcggcgagaaaccccagcgccggcgtgccgagcagcagcgtcagcgccatgattttccagccgtacacgtccatccccagcagcagcgccaccagcggggagagcataatcagcggcaggccggtcaccgcccagtgggccagcaccttcgccagcaccaccgccggcagcggcaccggcagcagcatcagctgctccaggctgccgtcctgcaggtcgtcgcgaaacagccgctccagcgccagcagcgaggccagcagcgccgccacctggatgatgcccggcgcgatacgcgccagcagctgcggctgcggcccgacgcttaacggaaacagggtgatgaccatcaggaagaaccacagcgggccggcgatgtccgcgccgtggcggaacgccacgcgcagttcgagacagaagacacgccacatcacagcccggcccccccgccggtcagcgccaggcggcggacggtgtccgcggcccccggcagcggctggtgggtggtgagaatgaccatcccgccctgcgccgtgtgcgccgccatccgccgggtgaggcgcgccacgccgttaacgtcaatggcggtgaacggttcgtcgagcacccacagcgcggcgcgggtcagccacaggcgggccagcgccacccggcgctgctgcccggccgagagctgagcgaccggcacgtcctcaaatcccgccagcccggcctgcgccagcgcctccgggagacgcgcgccgtcgccggggtggaagaagtgcaggttctcccgcgccgtcaggcgggttttgatccccggctggtgccctatccacagcagactgcgatggaagctgtcgcgcacgcggcgcaggggttcgccctgccagtacacctccccgccgtccgggcgcgccagcccggtcagcaggcgcagcagggtggtttttccggcgccgttgccgccggtgacctgcacccactccccggcctccacggtgaacgacagcccgcgaaacagcgtcctctcgtcccgctcgcagtacagatctctggcttcaagcattcccactcatcaacgtcctgtcagaaacctggtttaacatcacgcatatccggcagtttatgcgcgatccctttgtggcaatcgatacaggtctgtccatcttttaccgcctgatcgtgcattttcgccgcgacgcctttttgcgcggtcagatccataaagtcgaaattgtggcagttacggcattcctgcgagttgttgtctttcatgcgccgccactcattttgtgccattgtcaggcgatgagcttcaaatttctgcggtgtatctatcagcccaaataccttcgcatacagctctttactggctttgatcttacggatcatcttcggcccccactcatgcggcacatggcagtcaggacaggtggcacgaacgccgctacggttgttgtagtggacggtttccatatactcctcatacaccgtgttgcgcatttcatggcagctaatacaaaactcttcggtgttagccttttccattccggtattgaagccgccccagaagatgatgccgccgataaaaccgattaacagcagcgtccccaacgccaggcggctggggctgcgccaccatcgccagacgcgctttatccagccgggtttacggttagaattttccataatgacctcttatttcccgtaaccttgcgagggggtaaaggtattgtcgataatcggcgcggtatcagactgcggtacgtggcactgcaggcagaaataacgacgcggcgcgacgttgcccgacactttaccgtcgctgtccataaagtgcgtcggactgatacgcggcgcgcccgtcgtacgataactttccacgccgtggcattgcagacagcggttggtattggtcgtcacctggtagccctcgacgctgtgcgggatcatcggcggctggttgacgtaatttagcggcatacgttcctgctctttcggcatacgaatcgccccttcctgcgtcccggatacttccggcgactggctcagatccactccgtttgccgcccaaaccgcaccacttaccaccagggcaagcgtggccatccattgacacagcgctttcatcaggtcatggcttttcattgtttcgctcccgaactccatcgcatttacacttcatccttcgagctgcctctttgttggctgcgctcgaaaatcccagtcacatcgttatctatgctcccggggatttcctcgcttaccgccgcgatgcatcccgaatgatgttgcgtatcgttattgtaaaaacatcctcagaacagacatccacgcagcgaccgcaggtcatgcagtcgcggtgagtgacctgcgccgggctttgctcatccagcaccggcgcacgtagcacatgcggttccgggcaaacatgaaaacaatccatacagcgattacatttctcacgttttttggccgtcacggtcactacgcctttactgcctagcacgccatacagcgcgcccatcgggcaaatatgaccgcaccaaccgtgctcaacgactaataaatcaaataaaaacaaagcaataatcaacaacgcgccgctactaaatcccataatcagactacgacctaacagcgacacgggattaatccattcccacagcagcgtgccggtcaacgccgaaccgattaacaccaccaccagaaggacgtaccgtatatggcgtggaatcgtcgcagactggttcaggtcaaatttcctgcgcatccagttagccaaatcggtaacggggtttagcgggcaaacccaactgcaaaataatcgctttcccgccagcgcatacagcacagcgataatcactgctcccgtcagcgccacggtagcgggaagatgtccactggcgagactttccagggtaatcagcggatcggtcaacgggagggtatcgaacagcaaactactgctgtagttgccatgcaaaacccaaaagcccagccacgggccgctgagaaacatccccagcaccataaactggctgatacggcgtaacaccagccaacggtggctacgccaccagccttttttcgcccgcgcttctcgcccggcgtcgcgtttacgatttgccatctttcccctccagccagccgaagcggtaatggtgtcctaactcccctttcgccaatgacaacggcaacacttttatcgctggttgctccagtacgcagactttttcgcatttgccgcagccggtacaggcgtcgctgtgtacggtgggcagaaagcgcgcatgtttgccggtgcgcatgttgcgatccagctccagcgtgatggcctcatcgattttcgggcattcgcggtaacaaacgtcgcagcgcagcccctgaaagttgaggcagttttcctgatccagcagcaccgccagccccatgcgcgagtcatcaatggaggcgatatctttattcagcgccccgctggggcagactttggcgcacggaatgtcttcacacatttcgcaggggatgtcgcgagcgacgaaatagggcgtgcctgccgatagtccggaggccagcgtcgccagttttagcgtgtcgtatggacacgcctgaacgcactgcccgcagcgcacacaggcgctggcgaagacattttcattcagcgcgccaggcggacgcagccgcacgcccgatgcgcgcgcggtttgctgttgcaagcccagcgccacgccaaccgccgccagcccgcccgcagtgcgcacaacatcacgcaggaagcggcggcggccattttggggtttcgctgtacgggacataacgcgttacaccttcgccagcttaacggcgcacttcttgaagtccgtctctttagagagcgggtccgtcgcatccagcgtcaggttgttcactagctgagcggcatcgaagaacggcatatacaccagtccctgcggcggacggttacgtccacgcgtttcgacaatcgaaatcacttcgccgcggcgggacgacactttaaccttatccccacgacgcagatcgcgcgctttcgcatccagcgggtgaataaagaccaccgcttccgggaaggcgcgatgcaattcaggcacgcggcgcgtcatactgccggtatgccagtgttccagcacgcgaccggtggaaagccacagatcgtactcgttgtccggcgactccgccgcgggttcaaatggcagcgcgaagatcaccgctttgccatccggtttaccgtagaatttgtacccttcccccgcttttacatacgggtcgttgccttcgctgtaacgccattgcgtctctttgccttccacgaccggccagcgcagaccgcgcgcgttgtggtaatcgtcgaacggcgccagatcgtgcccgtggccacgtccaaaccaggcgtattcttcaaacagccctttttgcagatagaagcccagctcacgagactcatcgtttaactgatcctctttcagctcgctcagcgggaatttgctgaccgccggcgtggcgaacagaacgtcatacagcgttttgccgcgcagctccggcttctgagccaacaacgcctccggccagacctcctcggttttaaaacgacgggagaactgcaccagttgccagaggtcggatttagcttcgcccggcgctttaatttgctgacgccagaactgcgtgcggcgttcggcgttgccgtaagcgccttctttctcaacccacatggcggtcggcaggatcagatccgcagacagcgcgctcaccgtcgggtaaggatcggaaacaatgataaagttacgcggatcgcgccagcccggcatccgatcttcattgatgttcggcccggcctgcatattgttattacacattacccagtagacgttcagcttgccgtctttcaacgcgcgatcctgcgccaccgcgtgtaaacccacttttgccggaatagtgccagcggggatctgccagtgtttttcgcagatatcacggtgtttttcgttcgtcacgaccatgtctgcgggtagacggtgtgagaaggttcccacttcacgcgccgtaccgcaggcggaaggctggcctgtcagcgagaaaggaccgcagccaggctgggagatttttccggtcagcagatggaggttgtaaaccaggttattcgcccacacgccgcgggtatgctggttaaaacccatcgtccagtaagagatcacgcgcttattcggatcggcgtagagctgtgccaactgttccagttgatctttcggcacgccggtcatttcagcggtcttgtccagcgtatattctgccacgaaggctttatactcgtcgaagctcatcggctcggaagcgtcggagcccggattcttcgccgctttttccagcgggtgcgtcgggcgtaagccgtagccgatatccgtcgcccctttacgcaggttcacatgctttgtgaagaaatcctgatttaccgcgttgttctgaataatgtaattcgcgatatagttaaggatcaccagatcgctttgcggggtaaagacaataccgttgtccgccagttcaaagctgcggtgctggaaggtggagaggacggcaaccttcacgttcgggtcggacaaacggcggttagtgatgcgcgaccataaaatcgggtgcatctccgccatgttggaaccccacagcacaaacgcatcggcctgctcaatatcgtcgtagcagcccatcggttcatccatgccaaaggtgcgcataaagcccaccaccgccgaggccatgcagtgacgcgcattcgggtcgatgttgttagagcggaaaccagccttgaacagtttcgcggcggcatagccttcccagatggtccattgacccgatccaaacatgccgatcgcttctggtcctttctctttcagggaggttttaaacttctcttccatcacatcgaaggcctgttcccagctcaccggcgtaaactcgccgtctttgtgatagctgccgtctttcatgcgcagcatcggctgcgtcagacgatctttaccgtacatgattttgggcaggaagtagcctttaatgcagttcagaccacggttgaccggcgcgtcggggtcgccctggcaggcgaccacacggccctgctgcgttcccaccaacacaccgcaacccgttccgcaaaaacggcacggcgctttatcccatttgatggcttcctgctgcccgacaacggcgcgggcgacgcccggcacgctcagaccggcagccgccgcagcggccgcaacggcgttagctttcataaagctacgacgactgagtttcatggtgtttcctcaccttgctcatcctgctggtgataaaccagcgacaccgccagtacgccctcgacattgcgtactgactcaattgtttgcatcagcgtttcactctgatctgcttccgccaccacgatcagttgcccgctttcaacatcgcttaacgcgacttcgcaacccggcaacgtgttcaactgtgtgccaatggcggcgatgttctgacttttggcctgcacgaccaggctacagacctgccagttagtgcgcatggtggttctccgctttgatggctgacacggggcagatagccacacacgccccgcatccgttacaggcctgcgagtcaagctgcggctggtaaataccggataacgtgggacgaaaggtaatggccataggttcacaactgtcctggcaacgatggcattcaaccgattgcctggcgaggcagttttccgtgagcgtaaaaaccagatcccaggccctggtgtggcgcggaagaaaaagcgattcggtacaggcctgcgcacaggcataacaaaagctgcactcgccccgtttgaaatctacgctcggatatccccccgcccctcgctgcaggatgtcggcctcacacgcctggatgcaggcgtcgcaacgcagacaatgtgcgagaaaataggtcgtttctctggcccacggcggaagaatcccattgctggcgttgcgccaactgccggtcaacatgcttcgacgggataaatcaaccatgatatcgcccttccataacgacacgcttccatagggagtgaataccaataaaaaccgtacaatttatgagtagttgtttttgtaaataagatatttcaggatgtgtaagagatgcataccccgatagaggtaaatgctgttgccggatcaaaagagtgccgggtaaagacccgtaaacgtgctttttctcacatttcaatgagttatatagatatttatataacgaaaaccactaatagctgataatttcatttacattatcaatatcagaatattccactatataaaaagacgctattttattaataatcttgaaaatatgagtaaatacagattaatagataatatgaatgtgttaatctgttgtcagtgaataccgaaaacagcagaaaggaaatactgtgaacaatcaaatgaagatgtttgtccctgccgtcgtcttcgccgccctcgccagcgcctctgcctgggctaacaatggcgataccgcccagccgctggaaaaaatcgccccctatccgcaggcggaaaaaggaatgaagcggcaagtgataacccttacccctcagcaggatgaatctaccctcaaagtggaactgttgattggccaaacgctgaatgtggattgtaaccagcatcgcctcggcggcacgctggaaacaaaaacgctggaaggctggggctatgactattatgtctttgataacgtcacctctccggtatcaaccatgatggcctgccctgaaggtaagaaagagcaaaaattcgtcaccgcctggctgggtgaagacgggatgctgcgctacaacagcaagctgccgatcgtggtgtataccccggcgaatgtggacgtgaaataccgcatctggaaagcggacgctaacgtacagaacgccgtcgcgcgatgatgttacgctgcccggtcacacttaccgggcatctgaacacgccgactcacgcagcgctccggggttctttttaaaacacgtctggaaacccgctcgcccgcagcaaaaaataccccgatgcctggtggcgacgcgtggcatcttatcaggcctacccgcgtgcggacgtagggctgccatcaggcggtttatccggcgccataatccattacgcagtacgcgcaaccgcatcacgcgaagcggcgtcacgttcgtcgccggtgagttcggttaactgcccgttacgcatttcaagcagacgatcggcgtgaataaaatagtgatcatcatggctgatggcgaaaatggttttgcccatttcctgcattaacggcaacagtacctgataaaactcccggcggaaatgcgggtcctgatcggcggcccactcatccagcaaaataatatcgcgctcttccgccagcgccagcagcagtgcaatgcgctttttttgccctttcgacagtttaagattcaagatgcgcccgtcgtttagttccagcttgtgcgtcattttcaggtgctcaagccacttttcgaccagcgcgggattggcgggtttcccctgcggccccagcaggcggtcgaataaccacacatcggtgaacaccgcagaaaacagtttgcgataatcttccggctgcccggcggcaataggttgaccgtcaagtaaaatcgttcccgattgcggctggtataaaccggtcaataacatggccagcgtcgatttcccgctaccgttgccgccaattaaaaacagcagttcgccgcggtgaatcgtcaggttgatgggccccacggaaaacgcgttatcctgatagtggaaaaccacgttgcgcagctccagcgtcttccagtcgggaaaggctttcggctgtggaaaatcaggcttatacggggcgagcgcgaatttattcagtttattaaacgccacctgggcggtcagtagcgttggcaacgcccccaccgcagacagcagcggcgtgcgcaggaacagcaacgtcagtgaataggtcgccgcgacgttggtatccgcccagccgagactattcgccatccagaagaccaggcctatcgctcccagcatcatgatattcgaccagttgacggcgctcagatgaaaagtatcggcacggataatgtgatgacggtactctttggcgtccggggtatagcattgctgaaaaatctgctccgcacgctcgcggtttagcgtcagctctttgcgtccttccagcaccgtctgatagtcgttgtacagcttatcttcggtctcgcgcagggtcgccatatgctggtaaacccgcgccaccagcacaaatccgccccagatagtgaccaccatccagatagccgtaaccagcagcatttttgtcgatagcatcgccagatacgccgccgagccgacggtgaggataatgccctgcaccagctcaggcagacgcacaaaggcgatagtaatattgcgaatatcgctggtcagaccggccagtaaagaggcgctgcccagttgctcaatgcgttcaacgtgcgtatccagaatgcgcttgataaattcgctgcgcaggcggtaaacgaaatggtgtcccagagtggtgagcgccagttgggaacctaatgtgacgaccattagtaacaggagcagaccgagaaattccggcagcaccatgacggtggtgtccaccgtttcaatcaggcgctgattgataaacgcgatcaggccaatccccagcgccgcgctggcgaggctcagcgccatcacgctaataaatggccagcggtactgccgccagacaagaataagaagttccatgcatacaacccggaccgataataacagcccgcagtttaactaactccacctgcacagcaataataattcttatttttattctttttcagctgcctgacggaaggtgagattgtaacgaaattcaccggtcatgggatgaaagcccgctttaagcggctggataccatgataaaacagccgggactcgccgccccagaccacgatatcgccatgctccagtaagatccgctggatcgggtcgctgcgacgcaggccgccaaactgaaaaaccgccggcacccccaacgaaactgagacaataggcgcgcgcagatccggctcgtctttatcctgatgcagcgacagttttgcgccgggcgcgtagcgattgatcaggcaggcgtccggttggaagctcgcataccctgccgcgattgccgcctgacgacatacgctggcaaacgataacggcagcgcaggccagggtttatcagtcaacggatcgcgcacggcataacaataaccgtgacgatcggtagtccaccctaacgcgccgcagttggtcatcgccaccgacatggtgtagccgcccggcgtcaccatctgacgaaacggagactgactggcgacaaacccgatatcgtctaatagcgactgcgccgcgcgaaacgcaaagcggcgcaacaccaccgcgccaggcgccaggggctcttgccagggcgcttcatcagcaaatagatccagcattgctactcctctttttgcgcttctcgctttaatagctgcgcttttcgacgcacgccccaacgataaccggagagcgcgccatcgcgacgcacgacccgatgacacgggatcaccatcgccagtttattcgcgccgcacgcgctggcgaccgcgcgtaccgccgtgggtttgccgatagtcgcggcaagctgttgatagcttacggtttcgccgcagggaattgcgcataacgcctgccagacctgctgttgaaacgcggttccctggatatccagcggcaacgagagcagcacatcgcgtgtgttgatagccgcgacaacctgccgcacccgttgctgaaaaagcgcgtcagcaggttcgtggcgggccgacgggaaaagggtgtgtaattcagccagtagcgcgtcgtcgctatcaccggggagaatcgcgcaaatcccccgctcgctctccgccaccaggcaccgtccgtaaacccagtccgtcagcgcatagcgaacggagacattatcgccgcctttgcgaaactgttttgccgtcatgcccagcgtctggtcggcatgacggtagtagctactgctatccgggaagccagcgcggtaaatagccgccgtgatcggctctcctttcgccaaagcctcacgcagccgccgggcgcgccacgcctgctgccaccctttcggcgtcattccggtgctcgctttaaacagacggtgcagatgaaacgggctcatcgccaccgcctgcgccagaaacgccagcgttaccggcgtctcctgctcaagcaaacggcaggcgcaggcaatcttatccaaccgccgttgctgcgcgcgcgcattatccggctgacagcgcttgcaggggcgaaaaccggcgtccagcgcctgctgcgcgttggcaaaaaagcgaacatttttacgtaacgcccgcttcgagcgacaagaaggacggcaaaaaacgccggtggttcgcaccgcaaaaacgaaacgcccatccgcgctggcatcgcgcgcctgcacccgcagccagcattcatcatcgataagtaacgcttttttcatcatagactccttcattaagcatagtgcttgcttacatgcagtgtgtccgtaaatccgcccacaaaaacccgtaatcttgcgttttaattcttatcgctcaccaggaacgttttgaactgcggcgacatccaggttttaaagccttcaccttctttcatgatcataaataccgccagcccttccctccgcacgacctcttgcgccttttgcgtaccaagcaccatcaggccggtgtcccagccgtccgcttccaacgccgttggcgcgatgaccgtaaccgataccagattgtgttcaatggggcgccccgtttgcggatcgataacgtgcgagacacgcttgccatccagctcgtaatagttacggtagctgccggaggtgctgatgccatgcccgttgatatccacaatcgcctgcactgcgttttcccggtcggtcggcttctgaatcgcgacgcgccacggctgcccctgcgcattcatcccgcgactgcttaatgcgccgcccaccgagaccagataacgcgcaatgccctcctgctccatcagacgcgccagatgatccgccgcatagccctccccgaccgtggagagatcaacataaagatccggcagatctttttgcaaaaactgatgtccagccctgtcgataacctgcaaatgttgcaggcctgttttcgcttttgccgcatcgatttgtgctggtgttgggatatgcagcggctgccgatccggcccaaacccccacagattgaccagcgggcccacggtgatatccatcgcgccatccgtcttcgcgccaatacgcagcgccgaggtcacgatatccgccatggcttcgctgaccggccagggcgcaagactgcgtgaatggttaaaacgcatcaacgcggagtcatttttataggtagaaagcaaccaatcatcagcatcaagctgagtctggattttagtctgtaactctgcggcgcgtttcgcatcgataccaaccacgctcacccgccagagagtccccatcgttttaccttccagcacctgagcggcaggtgacgctgttgtcgtttcgggagcctcatcgcagcccataagtagaaaagccgccgccagacacacggcccggcaaaaagtcattttcatcgctgtttatcctcattcgaatggacgcaagcgtatatcaaaacgtcgtatttgtacgccggaataaggcatgaaaaaagggcccgcaggccctttagcaacatcttttgctgattagaactggtaaaccagacccagcgctacgatgtcgtcggtgttgatgcccgcatcgcgggtaaagtcgtttttatccagcaggttgattttgtaatcaacataggtggacatgtttttgttgaagtagtaagtcgcgccgacatcaacgtattttacgatgtcctggtcgccatagctggcgccgtaaccgttgctgatgtccttacctttagactgcaggtaagccacagacggacgcagaccaaagtcgaactggtactgagcaaccacttcaaagttctgcgctttgttggcaaaaccgtaagaggtggacgggttgctaccgttagaggtaccaaaacgggttgcgttataggtctgagaatactgcgctgccagatagatgttgttcgcatcgtatttcaggccgccggtgtaaaccgtggcgcgatcgccgttaccatacaggcgagcgttagcggtgttgttctgatcggcagtacgtttagacgtggtgatagcgccaccgacagagaagccttcgccgattgcataagtcagcgatccgccgtaaccgtcgccgttctggttcagcaggctgcgaccgttggtgttttcaccgctcacgctgccgtttttgccctgatactgtaacgcgaagtccagaccatccaccaggccgaagaagtcggtgttacggtaggtagcatagccgttaccacgctgctgcataaagttgtcagcgccgtaggtgtcgccgccgaactccggcagaacgtcggtccaggaggtcacgtcataggttacgccgtagttacgaccataatcgaaggaacctgcatcagcgaatttcagacccgcaaacgccacacgcgtccaggagtcgttgctgccttcagtctggttgccctgaatctgatattcccactggccataaccggtcagctgatcgttaacctgcgtttcgcctttgaagccgatacgcatgtaggtctggtcgccatcgctgcctttgtcgtcagagaagtagtgcaggccatcaactttaccaaacaggtctaatttgttgccgtctttattataaatttcagccgcattcgctgcgcccgccaccagcagagctggtaccaggagggacagtactttaactttcatgttattaaccctctgttatatgcctttattgcttttttatgccactgcttactggttaaccctcattaaccagtcggcaagtccattctccgcaaaaatacagaataatccaacacgaatatgatactaaaacttttaagatgttacagttatctacatagatgtttcaaaatatgaattttacggaacttttttaaagcaaaaatcaagtaaaaataagcacaaatagacaaaatatattcacgaaacttttaaaatcaacgggttaaattgatgaaattcatagcactgaatgataaaacagaatcttcattcgcaactaaaatagtgaccgctatcatcattaactttatttattaccgtcattcacttctgaatgtctgtttacccctatttcaaccggatgcttcgcattcggttttttttaccctttttcagacacacccggctgatttatgctacctgcctaaaactatcacggttattcactacactcccctgctcgaccgttcgtaagacattagcaaataatttcttgatatttagtgctaaacatttataagtagtctttatatttgtaccgttctgcgaaggttgtacgcttttcccgtcccgccgacggagcgcgtgttaagttgcccggcatgacgtaagagtctggaaattcattcattaccctttatactgcccttcaccttcagcgttgcttttacaggtcgtaaacataaatgagtcagtctgacacaacggtctctacccgattctcccttctaccgggaagcattacccgtttcttcttattgctgatcattgtgctgctggtaacgatgggcgttatggtacagagcgccgtcaacgcctggttgaaagacaaaagctatcaaattgtcgatatcacccacgctattcataaacgcgtggatacctggcggtatgttacctggcaaatttatgacaacatcgccgcgaccactacgccatcgacaggtgaaggacttcaggaaacgcgtctgaagcaggatgtgtattatcttgaaaagccgcgacgtaaaactgaagcgctgattttcggttcccatgacagcgccacgctggaaatgacgcagcgtatgtcaacttatctggatacgctgtggggcgcggaaaacgtgccgtggtccatgtattacctcaacggacaggataacagcctgattcttatctctaccctaccgttgaaagatctctcttccggctttaaagagtccactattggcaatatcgtcgattcccgccgggcagagatgttgcagcaggcgaatgcgctggatgagcgcgaaagtttctcctcattgcgaaaactggcctggcaaaacggtcactattttacgctgcgcacgaccttcaatcagccaggacatctggcaaccgtggtggcgtttgatctgcccattaatgatttaatcccgccgggaatgccgctggacagttttcggatagagcctgacgcaacccaagcgacggggcgaagcagtgaaaaggaagcgcctgatagcgtcacgattagctttaacggttcaaaaattgagatctcctcagcgcttaactctaccggaatgcgcctgatctggcaggtaccgttcggtacgcttttgcttgatacgttgcaaaatattttgctgcctttactgctgaacatcgggctgctggcgttggcgttatttggctacgccacgttccgtcatcagccgggacggtcgacggaatcgacatccggcaacgcggcgaataatgagcttcgcgtcttacgcgccattaatgaagagatagtttctctgctgccgctgggtctgctggtctacgatcaggaaggcaaccgcaccgtgatcagcaataaaatcgccgatcatctgttgccgcatcttaacctgcaaaatattaccagcatggcggaacagcatcagggcgtgattcaggcgacaattaataacgaactgtatgagatccgtctgtttcgcagccagatcgctccccgcacgcagatctttattattcgcgatcaggaccgggaagtgctggtgaataagaagcttaaacaggcgcagcgtttgtatgagaagaatcagcagggccgcgccgcctttatgcaaaatatcagcaacacgcttaaagagcccgtacgccaactggcggttaacgccgcagcagtcaccacgccggaaagcctgaaactggcggatcaggcggatgtattggtacgtatgatcgatgaaatccaactggcgaatatgctggaaaatgacgcatggaagagcgaagccacgctgttctccctgcaggatcttattgacgaagtcgtgccggaagtgctgcccgccattaagcgtaaagggctgcaactgctgattaataaccatcttagcggcaacgatgaacgctggggcgatcgtgacgccctgcgccggattttgctgctgttgattcagtatgccgtcacaacgaccgctatgggtaaaattacgcttgaagtcgagcaggatgaatctatcgcggagcgtctgactttccgtattctggatacgggcgaaggtgtaacgttaaacgagattgataatctgcatttcccgtatatgaatgaaacgcagggcgatcgttacggcaaagcgaatccgctcaccttctggctgtgcaatcaactggcgcgcaaactgggcggtcatctcaacattaaagcgcgagaaacgctgggcacgcgctataccgttcatgtcaaaatgcttcctcacgatcagcatactcaggtcgaagagcgcctgctggacgacgtgagcgtgatggtcgatgtgacgtccaacgaggttcgcgcgattgtgctgcgtcagttagaaaactggggcgccacctgcatcacgccggatgaaaggcagataagtcaagaatatgatctctttttaacggataatccgtctaatcttactgcctcgggcttgcttttaagcgatgatgagtcaggcgtgcggaaaattggcccgggtcagttgcgcgtcaactttaatatgagcaatgctatgcaggaagctgtactacaacttatcgaagagcagctggcgcaggaagagattcccgcctccccgctcggcggagatgaaaatgccgagcttcatgccagcggctattatgcgctatttgtagacacagtaccggatgatgttaagaggttgtatactgaggcggcaaccagcgatttcgctgcgctggcccaaacggcccaccgcctgaaaggggtgtttgccatgcttaatctggtacccggcaagcagttatgtgaaacgctggaacatctgattcgtgagaaagatgctccaggtatagaaaaatatatcagcgacattgacgcctacgtcaaaagcttgctgtagcaaggtagcccaatacatgaacaatatgaacgtaattattgccgatgaccacccgattgtactgttcggtattcgcaaatcacttgaacaaatcgagtgggtgaatgttgtcggcgaatttgaagattccacagcattgatcaacaacctgccgaaattagatgcgcatgtgttgatcactgacctctccatgccgggagataaatacggcgatgggatcaccttgatcaagtacatcaagcgtcattttccgagcctgtctattatcgttctgaccatgaacaacaacccggcgatcctgagcgccgtgttggatcttgatattgaagggatcgtactcaaacagggtgcgccaaccgatctgcctaaggcgctggccgcgctgcaaaaaggcaaaaaattcaccccagaaagcgtttctcgtctgctggagaaaatcagcgcaggcggttacggcgataagcgtctgtcgccaaaagagagcgaagtattacgcctgttcgccgagggtttcctggtcaccgaaatcgccaagaagctcaaccgcagcattaagaccatcagcagccagaagaaatcggcgatgatgaaactgggcgtagagaatgatatcgcgctgctcaactatctctcttctgtcaccctgagtccgacagacaaagaataaatcgcttttatgttacccagcctgatggcgctacgcttatcaggcctaccagtcgactcatcttttacaggccggacaggcgacgccgccatccggcattttttatgcccgcgttttacgtacccgctcggcatacaccgccagcgtctgtttcaacacatccagcgtcacaggcttcgacaaacagctgtccataccggactccaggcaacgttgtttctcttccgccagcgcgttcgccgtcacgccgacgacaggcagcgtcagcccaagctgacggatacgctgcgtcaggcgatagccgtccatgttcggcatgttcacatcgctcagaacaatatcgatagcatttttactcagcacattcagagcgtctacgccatcattggctgtcttacactgataccccagcgatcccaattgatcggccagcaagcggcgattgatcggatgatcgtcaacgaccagaatcatcatgtcgtcatttgaatctgcagttttatccgtcgtcggcaatgcgctggaaagcgcttcactatccagctcaatactatagatacgcgccaacagcgcgggcaactcatgcaccgacgccacactatgcacccactcgcccggcgctctttccaacggaatcccgatatgacggcggcaaaagacgaccgccgccctcccctgccaggtatgctccagcgcgtcatcgacaatcaaaatatcgtccgcggcgggttcttgcccttcataacgctgcgtatgaacgccgctacgcgccagactggtctcaataaactggcacaaagaagtattgcgcaccgccagccaacagcaggttccggcgagtccttccacgctctttttcacagggtattgcgcgccataaagcgggatgcgcagcgtaaactggcttcccatgccaggctccgaatcgacggaaatatcgccgtccatcatgctgatcaatttttcgcaaatcgccagccccagaccggtcccctgaaagttacgctgtacgccggttcccacctggaagaagggatcgaacaggcgaaccacctcttttgccggaataccgacgccggtatcccgcacgcgaatgctgagataatccccatcacagcgcacatgcagcacgatgcagccaatatcggtaaacttaatggcgttgctcaacaggtttgaaataacctgctgtaaacgcatcgggtcgccgttcagcgataccggcacgtcaggctcaataaaacaatacagaccgagctgcttacgcaccaccaacggcagataattggcggtgatatggttcatcacctctcgcggtgaaaattcgcgcggctcaatctttagctgttccgactcaattttcgagaagtcgagaatgtcgctgataattttcagcaacagactggaggagttattcatcgccgtgaccagacgttccacgccttttggcagctctttggtttgcagcagatcgagattgccgatgataccgtacagcggtgtgcgcaattcatggctgaccgtcgcaaggaacatggatttagactggcttgcctgctccgccgcctgcgccatctcttgcagcgactcttccattttgacgcgcgtactcacatctaccaacacgcaaatcgcgacgttttcattgcgatagcgggaatggacgaagctaatttgcaaattggtattattgctggtcaatacatcaacaaagttgacctgctggccgcaaataatttgcgtcaggcgctgtctgtcttcatgcgtgagcatgttcaggtaggtgtgcgccagttcgttactcagaatattgacaccatcaatagtgcgcagaatacagatccccaccggcgcggaggcgacgattttacggttgaactgttcatgctcttccagacgctgagcatcgctctccgccggaataaaaattcgccgctcatacatccgcgcaagcgtaaacagccctgcgcccaccagcacgttcagcaggatagcgttcaggataagaatacgaatacgctccaggactaaatctacaggcacagaatagacaatactgagcgaggatggcggcaggctttttttgagtaccagttcgcgaaaacctggcgtataaccaaaccaggaacgctcctgcatccagcgcggctccgctttaataatgccgtcaggaccggtcaacgaaatcagcgaatggccgttctcatcaataatagtgacgcccatcggcaaactgccgggcgtgaaaaaattttccatacggatggactgctcgacgcccagcagcgcctgcagacggttggccagatacaccggcgtcagcgcataaaagtagcccacgccctgacgcgcgccctggcttatccagaaaaggttattcccactttcttcctgcggcgcgttgcggtatttcataatccgctcatgtaacgcttttaacgcatcatcgcgctccacgggcatttcacgcaggccgaaattcgccatacagaggttatcgctgccaatcaggaaaacgcggttaagatcatacgccgctgaaaagttgtcgcgccagtaacgcataaaccaggccagcgactccagcgatccgcgccaggcggagcccatcgccgcacagtctgagtcggcaaatagcggttcaaagtccggcaccaccattttgtcatcacgcgcacgcgacgacatgacgccgttttccgccgttaaacggttctcggcgatatatttgagctctttcatcacatccgacgtgcgctggataaaacgctgcgcctgatcggagctaaggttgaactcctgacgaatttcagactcccgctggtgcagggcattgacgatgtaaaacaccgaaacaaaggcgattaagagccaaatgagtaacgctaacgctctgaataagtagcgcgagactttcagcgtagttcgaaaggaagcaaggtatttcaaaggggcgaagctccgcctcaggatgtaaatagagtgtgactaaggtagcggtaaatgacgtagcccgcaacggcaaagaaaaagggccggatatccggccctcgcacagcaataacattactcgtcagcgtcatccgcaacgtcgtcatcgctttccgcttccggggcgatatcctcatccccttccgccacgctgccgtcgatagcgtcgagttcttcgtcatctaccggttcagcaacgcgttgcagacccaccacgttttcatcttccgccgtgcggataaggataacgccctgggtattacgtcccactacgctgatctcggacacacgggtacgcaccagagtaccggcatccgtgatcatcatgatctggtcgcaatcgtctacctgtaccgcaccgacaacggaaccgttgcgctcggtcactttgatagagataacgccctgcgtcgcacgagacttggtcgggtactcgtccgctgcggtacgcttcccgtagccgttttgcgttacggtcagaatagcgccttcgccgcgtgggatgatcagagagacgactttatcgtctcccgccagcttaataccgcgcacaccggtcgcggtacgccccatcgcacggacggcgtcttctttgaagcgcaccactttacccgcggccgagaacagcatgacttcgtcagaaccagaagtcaggtcaacgccaatcagctcgtcgccgtcgttgaggttcaccgcgataataccggcggaacgcggacggctgaattcggtcagcgccgttttcttcacggtaccgctggcggtcgccataaagacgttgacgccttcttcatactcacgaaccggcagaatcgcggtgatacgttcgttggcttccagcggcagcaggttgacgatcggacgaccgcgcgcgccgcggctggcttccggcagctgatagaccttcatccagtacagacggccccggctggagaagcagaggatggtgtcatgggtgttagccaccagcaggcggtcgataaagtcttcttctttaatacgcgcggcagatttacctttcccaccacgacgttgcgcttcgtaatctgtcagcggttgatatttgacgtaaccctggtgagacagcgtcacgacaacatcttcctggctaatcagatcttcgatattaatatcggcgctgttggcggtgatttcggtacgacgctcatcgccgaactgatcgcgaattaactccatctcttcgcggatcacttccatcaggcgatcggcgctgcccagaatgtgcagcaattcagcaatctgctccagcagctctttgtattcgtcgagcagtttttcatgctccaggccggtcagtttctgcaaacgcagatccagaatcgcctgcgcctgctgttcagtcaggtagtactgaccgtcacgcacgccaaattctggctccagccattccggacgcgcggcgtcatcaccagcgcgctccagcatcgcagcaacgttgcccagatcccacggacgcgaaatcagcgccgcttttgcttccgccggcgttggcgcgcggcgaatcagttcgataatcgggtcgatgttggccagcgcaatcgccagagcttcaaggatatgcgcacggtcacgggctttacgcagttcaaaaatagtccgacgcgtcaccacttcacggcggtggcgcacgaacgctgaaatgatatctttcaggttcatgatcttcggctggccgtgatgcagcgccaccatgttaataccgaaggaaacctgtagctgggtctgggagtagagattattaagcaccacctcgcccaccgcatcgcgtttcacttcaatcacgatgcgcatcccgtctttgtcggattcgtcacgcagcgcgctgatgccttccacgcgtttatctttcaccagctcggcgattttctcgatcaggcgcgctttgttcacctgatagggaatttcatggacgatgatggtttcacggcccgttttggcgtcagcttcaacttccgcgcgggcgcgaatgtacactttgccacgaccggtgcggtaggcttcttcgataccacgacgaccgttgatgatcgcggcggtcgggaagtccggccccggaatatgttccatcagcccttcaatgctgatgtcttcgttgtcgatatacgccaggcagccgttaatcacttccgtcaggttgtgcggcgggatattcgtcgccatacctactgcgataccggaagaaccgttcaccagcagattcggaattttggtcggcatgacgtccggaattttttccgtaccgtcatagttatccacgaaatccaccgtctctttttcgagatcggccatcagttcgtgggcgattttcgccagacggatctccgtataacgcattgccgccgcggagtcgccgtcaatagaaccgaagttaccctgaccatccaccagcatgtaacgcagcgagaatggctgcgccatacgaacgatggtgtcatacactgcggaatcgccgtggggatggtatttaccgattacgtcaccaacgacacgggcagattttttataggctttgttccagtcattgcccaatacgttcatggcgtaaagtacgcgacggtgtaccggcttcaggccatctcggacatccggcagcgcacggccaacaatgaccgacatcgcataatccagataggagctcttcagctcctcctcaatgttgaccggtgtaatttctctcgcaaggtcgctcatctaaccgctatccctctactgtatcccggattcaaaggtcgcaaattataacacattcgcccacgtactggtaaacggaatgcagccagacaatgctttattcgggtgccgcatgctctcttcatttataagcgtggtcttggcgtttattggcgatcggcttcagaggcgacacaggggagatcggggcctggccaggaagaggttagaaaatcaatacctcccgtgtatacccgtcatacttcaagtttcatgtgcgttggctgcgagttactcggcccatccctgggcctcgccccgtcgcggttagcgcaagcgctgttcaagacggttaaccattttatcctgcaactcgaattatttaggggatatgccgggaggcataaaccataatcagtatcaccagatgctatttaatcacataggccagatattctttcactacctcatcgtttaattcctgacccaatccgggctgttccggcgcgacataatagccattttccggttgataatcgtgggtacaaagttcccgaatagatgctttcatcgcattggtatgatgctcatgaataataaagttgggaattgctgtttccatatgcagcgcggctaccgtggaaacaggaccgccgcaaacatgcacctgtacagtggtgtcataaatattagcatagtcacagattttctttccttcggtaattccgccgcagagacacaaatcaggttgcgctacggcaatagactgcttctccagtaattccctgtatccccatcttgtgtaggaacgctcgccagtggcgattggaatcgttgttgaacgggaaactttctgcatattatcagaatttaatggatgaatcggttcttcataaagaaagatacgatacttttctatcgccttcgcaaattgaatagctgagtttgtaccgagaagagaatggatttccacgataatatcagcatcatcccccattgcttcacgcatagcggcaattcgcgcttcccccatttttaattgatcggccagtaacaatcctgaatagttacgatttctattctgaaaaacacagtcatcgccattacgatcgatttcgagtggatccactttaatcgcatcatatccatcgtcaagagccgcacgcgccgcctcagcatattcctcaggtgtcactaatatatggcgtttatccccccaaccaaattgtaactgactagcataggttcttaatttttcattagttttcccgccaaggagctgataaacaggtacacctaaatatttacctttgatatcccaaagagcaatatcaatagcgctcattccggcataaaaaacgttcccgccccccatcccccaaaaagtctttctgaaaaagaactcccaaattttttcgatatttagtggatcttcacccacaatcaatggcgccagatctctgatgatccctacgccagctttagcgcctgcgccataggccagtcctacttcgccaataccacttaatcctgagtcggtattcacccggataagtactggattataggaggacatcgtttgatctcttttttttaattcacagtcaaaaacttcaatagacgtaattttcataatttctccatttatcaggttcgtgatacaacatttgtttgttggcttttttcttttttcacatcaattttcattaacgccaaaacggctaccgcagcgaagcaaagtattgcctctacaataaatattcctgtcgcaccataatgagtagaaacgaatcccagtgatttattaatcaggaatccgccaagacttgaacatgagttaataaacgcaatgctgatagccaaccctgacggcgacaataatgcagaaggcagcgcccagtaaggtccgtaatagctgaggatcccaacaccatagaacgttagccccagcattctcagcgacattgaggggacaagagcaatcatcagaaaaccacagcctgccagaaacatgggtaatgcagcatgccattttcgttcattctttttatcggaatgccagccccaccagggcatgctgaacatagcgaaaataaacggaatactcatgattaaaccaacgtcagtatccgtaaaatcagctgaaaatcccttcaccaaccccggcaaccagtagtttgccgccagagcagccgcctgaatcaacatgtaggcgaaagaaagctgaagcaaaactggatttttgattacggaaagaaaggatgagttggtatttttatttaatgcagctgcggtttcattgtcagtacgtaatttattaactaaggccgatatctgctgtggcgtaagccatttagccttttctggactgtcaggcagtaaataaaatgtcaggatgccaaggaatacggtagggataccttcaatagcaaaaagccagcgccagccttcataatccggggtattcaaatgctcgatgatccaaccagacatcggtgcagccaataccgatgcaacagcaatagataacatgaagaaactattgacttttccgcgttcacgagccgggaaccagcatgcaagataataaaccatgcccgggaaaaagccagcttcaaatacccccaaaaaaatgcgagccagcaaaatatgttgagtatctttagcaaaaaaaatcagcccagttaccgctccccagccgataataatggaactaatccattttcttgcgccaagcttttgcaagccaatgctactcggaatttgaaagattaaatatgatatgaagaatatagaagaaatattagcgaaatcctcaggcgtaataccgagagattcattcatgcgtaatgcagcaaacccaatattgacacgatccatatagttaaaaaagtaaagaataaaggccaaaggaatgattttcctttttacaatacgaattgcatcgtataaattttcttgtggactactcattttgcatcaccttttatgattcaatgaataagggtattgaccggaatcgatgttacgtaaaaaacaatacaattcaaaagctaatgtgtcatatctgatatatcagcaagcaaacttaatgaaatatacaataacaacaataaagtatgtaaattttcttatatctgatatattagatccgttaattttgaataaattaattacaatggagccgggtttaaccatggaggagaagaaaatgaaaaatagattaaagcgtgactttagtcacatatcaattgaaatacccaaatccatcacccaggtgattaaagagaaaataagggagatgattatccatggcgatttcgatcttgggcaagcgatcagtgaaaatgaactatcaaatattctgatggtaagtaaaacaccaattcgtgaagcttttatttggctgagctataatgaaaacttagtcaacatcattccccgcagtgggacatttgttttttctgtcaccgacgaggatatcaatgatctcatcaaaatgagggttatccttgaacagggcgcaattcgtgaagcgatggagaaaaatgctaacaatgtcatagtcgaattaagcaatattttatcgaagtcagcaaaaattaatgcagagcgagatacgcaagcttacctcaaactggatcatgattttcattatgtttttgtgaaatatgccgataataaatacatttcacaagcacacctgttgatctcagcacgtttattggcaattcgctacagactggattttaccgctgaatatatcaccagctctaaccgtggacatgccactattttggatatgttaaaaaacaacaacgtcgagggcgtctgtaattttatcacgcaccacatcggtagcggttttacagaacgcgcaagaaaacttcttgcgctgaaagcgtaataaagacggcagtagatataacgcagcgactttgcacctgctatactgccccgatagatcaatagcggaatctcatgtactcatgaacactgaaaaaccgtcggtagctcacaacgttgaccataatgaaatcgccaaattcgaagccgtcgcgtcgcgctggtgggatctggagggcgaattcaagccattgcatcgtatcaaccccctacgccttggctacattactgagcgctcaggcggcctgtttggtaaaaaggtgctcgacgtcggctgcggcggcggtattctggcggagagcatggcgcgcgaaggcgcaaccgtcaccgggctggatatgggctttgagcctttgcaggtcgccaaactgcatgcgctggaaagcggcatcgaggtagagtacgtgcaggagacggttgaggaacatgcggcaaaacacgcccagcaatacgacgtcgtcacctgtatggaaatgctggagcacgttcccgatccgcaatcggtcgtccacgcctgcgcccaactggttaaacccggcggcgaggtgttcttctcaacgttgaaccgcaatgggaaatcctggctgatggcggtcgtcggcgctgagtatattctgcgcatggtgccaaaaggcacgcacgacgtgaagaaattcattaagcctgctgaactgttaagctgggtagatgaaaccgtcctgaaagagcaacatatcaccgggctgcactacaacccgataaccaatactttcaaactcggtcccggagtagacgttaactacatgttgcatacccgcgctaaaaaagcctgacatcaaagaattttcctataagggttgcgttagatcatcgggcgcaacctttctcttcgatgaagaaatcagcattcgatcaaattttgatttttttttatgaattgttgacatcctctccaggccttatcagacgcgcatttagcgattcttacgcttttgcaaccgcaatttaacgccaaaatcaactcttgtactcaaaagaatccctactagaatactcaccatatagcgtttcacttatcgattaccccctatatatagtatttatccacagagttagtcacaacgtggcgttgtggataagcggggggatatttttctttcacggacaggtaaacaggtagaaaaccacatgaatcagagtctgctggtgacaaagcgtgacggccgtactgagcgcatcaatctcgacaaaattcatcgcgtgcttgattgggcggcagaaggactgaataacgtatcggtttctcaggtcgagctacgctcgcatattcagttttatgatgggattaagacctccgatatccatgaaactattattaaggctgccgcagacctgatctctcgcgatgcgccggattatcaatacctggctgcgcgtctggcgattttccacctgcgtaagaaagccttcggccagtttgagccgcccgcactttaccaccatgtggtaaaaatggttgagcttggcaaatacgacaatcatctgctggaagactacacggaagaagagttcaagcagatggattcgtttatcgttcacgatcgcgatatgaccttctcctacgctgccgttaagcagctggaagggaaatatctggtgcaaaaccgcgtgaccggcgaaatctatgaaagcgcacagttcctctacattctggtagcggcctgcctgttctcgaactacccgcgtgaaacgcgtcttgactatgtaaaacgtttttacgatgcggtctctacgttcaaaatttcgctgccgacgcccatcatgtccggtgtgcgtaccccaacccgtcagttcagctcctgcgtactgatcgagtgtggcgacagtctggattccatcaacgccacctccagcgcgattgtgaaatacgtttctcagcgcgccggtatcggtatcaacgctggccgcattcgtgcgctgggcagcccgattcgtggcggcgaagccttccacaccggctgcatcccgttctacaagcacttccagacggcggtgaaatcctgttcgcagggcggcgtgcgcggcggcgcggcaaccctcttctacccgatgtggcatctggaagtggaaagcctgctggtgctgaaaaacaaccgcggcgtggaaggcaaccgcgtacgtcacatggactacggcgtacagatcaacaaactgatgtatacccgcctgctgaagggcggcgacattacgctgttcagtccgtcggatgtacccgggctatacgatgcgttcttcgccgaccaggacgaattcgaacgcctgtacgtgaaatatgaacacgacgacagcatccgcaaacagcgtgtgaaagcggtcgaactgttctcgctgatgatgcaggaacgcgcctctaccggtcgtatctatatccagaacgttgaccactgcaatactcacagtccgttcgatccggttgtcgccccggtacgccagtctaacctgtgtctggagattgccctgccgaccaaaccgctgaacgatgtcaacgatgaaaacggcgaaattgcgttgtgtacgctgtctgcattcaacttgggtgccattaaaactctggacgagctggaagaactggctattctggcagtacgcgctttggatgctctgctcgattatcaggattacccgattccggctgccaaacgcggcgcaatgggccgtcgtacgctgggcattggcgtgattaacttcgcctactggctggcgaaaaacggtaagcgttattccgacggcagcgccaataatctgacgcataaaaccttcgaagccattcagtactatctgcttaaagcgtccaacgaactggcgaaagagcaaggcgcctgcccatggttcaacgaaaccacctatgcaaaaggcattttgccgatcgacacctacaaaaaagatctggatgcgattgtcaacgaaccgctgcactacgactgggaacagctgcgtgagtcgatcaaaacccacggtctgcgtaactccacgctatcggcgctaatgccgtcggaaacgtcgtcccagatctccaacgccaccaacggcattgagccgccgcgcggctacgtcagcatcaaggcctcgaaagacggtattttgcgtcaggtcgtgccggattatgagcatctgaaagacgcttacgaactgttgtgggagatgccgaacaacgacggttatctgcaactggtgggtatcatgcagaagtttatcgatcagtcgatttccgccaataccaactacgatccgtcacgtttcccgtcaggaaaagtgccgatgcagcaactgctgaaagatttgctcaccgcgtataagtttggcgtgaaaactctgtactatcaaaatacccgcgacggcgcggaagatgcgcaggacgatttggcgccttctattcaggacgatggctgcgaaagcggcgcttgtaagatctgatgaatagtgccgggtagcgctatgcttacccggcctacgattgtacggtttgtaggccggataaggcgcttgcgccgccatccggcgctcatcccataaaggattcacttcaatggcatacaccactttttcacagacgaaaaacgatcagctcaaggaacccatgttctttggccagccggtcaacgttgcacgctatgaccagcagaaatatgacatcttcgaaaaactgatcgaaaaacagctctctttcttctggcgtccggaagaggtcgacgtctcccgcgatcgtatcgattatcaggcgttgccggagcacgaaaaacatatcttcatcagcaacctcaaataccagacgctgctggattccattcagggacgtagcccgaacgtcgccctgctgccgctcatttccatcccggagctggagacgtgggtagagacctgggcgttttctgagacgattcactcacgatcctacacccacattattcgtaacatcgtcaacgatccggctgtcgtttttgacgatatcgtgaccaatgagcaaattcagaagcgcgccgaaggtatctccgcctactacgacgaacttattgagatgaccagttactggcacctgctcggtgaaggcacccataccgttaatggcaaaacggttgtcgtgaatctgcgtgagctgaagaaaaaactgtatctgtgcctgatgagcgtgaacgcgctggaagccatccgcttctacgtcagcttcgcctgctctttcgcatttgccgagcgtgaactgatggaaggcaacgccaaaattatccgtctgatcgcccgtgacgaagctctgcatctgaccggcacgcaacatatgctgaacctgttgcgtagcggcgtggacgacccggagatggcggaaatcgccgaagagtgtaaacaggaatgttatgacctgttcgtgcaggcggcgcagcaggaaaaagagtgggcagactatctgttccgcgacggttcgatgatcggcctgaataaagatatcctgtgtcaatacgttgaatatattactaatattcgtatgcaggcggtggggctggatctaccgttccagacccgctccaacccaatcccgtggatcaatacctggctggtgtccgataacgttcaggtcgctccacaggaagtagaagttagctcttatctggtcggacaaatcgattcggaagtcgataccgacgatctgagtaatttccagctctgatgggacgcgtcacgctgcgtatcactggcacacagctgctgtgccaggatgaacacccttctctgctggccgcgctggaatcgcataacgttgaggtggagtatcagtgccgcgaaggttattgcggctcctgtcgtacccggctggttgccggtcaggttgactggattacggaacctttagcgtttatccagccgggagagattttgccctgctgctgcagggcaaaaggcgatatcgaaatcgagatgtaactcagtgcaactcgctggtggaaaccaacggcatcacgccacgttttttcatctgcacggcatacagtgcgccagcgagtaccaccaacaccgcgccagcgacataaatcatacgatagccaactgactcaaccatcattcccatgataaaggcgccaatcgccattccggcgtccatcgcgttaaagaacagtgaattcgccacaccgattttatgcggttcaaccgagctgataatttgcgtctggaagaccggcgtgaccgaaccgtagccgataccgatgagaccaccggaaataatcatcatgatgctgccattggtgtagcccagcgccaccagaccgatggtaaaagccaacagacatggataaacaacatatttcggcccttttttatcacaaatattcccggtgaaggtacggcatatcatcagtaaaatcgcgtagcacagcaggaaattactggccgccgccattaaatccagctcacgcgcatacagcgccaggaaagccgacacgccggcataggagaaagtcataaaaaaggtgaccagcgcaaaaggcaaggcggcgcggtcaaacatcgcggaaaaacccagattcggtttcgaaccatcggcatgacgaattaccggaggaaccgtcacaatcagggaaagcacaatccctaacgccgctacagcggaacaaagccagaatgcggcagtgaacgcgtcccagcgggccatattcaaaccgatccacggtcctacgaccatcgccaggcccatcgctaaagagaaaaagctgatgccctctccacgtcgggaggccggaattaaccgcgctgaaatagttccttttaccgtggtaataacaccaaacgtaatcccatgaagtacgcggataaagagcagcgactcgatagaatggcaaaccggatacagcgcggtaatcaccaaaaaagccagagaagagagcaccagaatctttttattcgaatattttcccacccattgtccggcaaatggccgaataacaattgccgcggccaggaaacatgtcactaacagcccggccttatctgcagaagcatgcaggcggtcagcgatataaatgggtaataaagttagcagtacataaaaaacaaaaaagataataaaactgactatggtgattgcccaaaaatctttcgtccataatttttctttcattcttaacgacccgctcagatggcgcacgcaggcaacgctcagctcaactgaacacctatcaggtgcgtcaaaatgtgatgtattcgatagaatcacagtataaacaagtgcactctattagaaaaattaatcgttttaattatattgattaggttttactaatgacactaacccaaatccacgccctgcttgccgtactggagtacggcggatttaccgaggccagcaaacggctatacatgacgcaatccgccgtcagccaggccatctccgcgcttgaggaggagctcggcgttgacatattgattcgtgagcgtcgtaaagagatcgagcttaccgccgccggtagccgcatcgtcaggcacttacgcgcgatccagcgcgacgtcaacgcggtaaaagagattgccgaacaagaaaaaaagaacccggcccgtacgctacggattggctgttttcccagcgcctgcgcctgcattttacccggcgtcattcgctattttgaaagccatcatccaaatgtaaaaattatcccttatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacggtaacggtcgaagaactgatggacgaaccacttattgtcagtaaaggtcgttatgaattaagcattatggcgttgtttaaagaaaagggtattgagccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttccctgttagcaaaagaaccgccggtagaaggaagtccgctatttttattacaaaaatgtatggaaacactgaccgatgaggggttgctataaaacaaccccgcctgatggcattgcgtttaccagacttacgctggcaaacgttgcgccaggccggatgaggcgtttatgccctcatccggcgcgtcacttcgactatggcaaacctttagtcatttttttgcaggaacatgaccgccttatccgggaagtcagtgaacagcccgtcgacgcccgccttgttatacaggatgtcgtacaactgattgacgtctgtggcatagtccggcaattgatcggcacgcacagtgtaaggatgcactaccatcttattctgatgcgcgtcttgcaccattccagtcagcttgatattccctttcgttgagccttccgcaaccagcatatggtaatccggaccaataccgtccgcatattccgccacctgcttcatagcgcccggcttaaacatccagtcgtagttgtaatttacccaacgaccgtccggctgtttctgctgtgtttcattccagtcggtatacgcaataagttgaaccagattgagatccatccccattttgggttccagttcattcttaatacgtttcagctcagcgacatcaaaacactgcaaatagacattgtcctgcttgccggtgtaaccatacttcttcagcacttccagcgttttcgcggcaatatctttcccttcctgatgatggaaccacggcgctttaatttccggataaataccgatatttttaccggtagagtgatttaatccctgaacgaattcaatttcctcttcaaaggtatgaatgcggaaatcagattttcccatcgggaaacggcccggataagtttgtacttttttgccgttttcaatatcaaacccttcggtaaacttcagggatttaatttcatccagcgtaaaatcgatagcgtaatagcgcccatctttacgcgcccggtccggaaaacggtcagcgacgtcagtcacccggtcaaggtagtggtcatggaggacgaccagatggtcgtcctttgtcatcactaaatcctgttccagataatctgccccttgcgcatacgccatcgctttcgccggtagcgtatgctccggcagataaccgctggcaccacggtgggcgataacgactttttcagccgccacggcgccgcttccgatggtcattcctgccaacattaacgccacgctaaggtttttcagtgtggttttcatgttattagcctccgttgcgttttaactgcagctcatcatgatggcgtttttcaccaatcatcacgaccaccagcaggattaccgccagaatgctgccgccaatcatcaccataaagccgccatcccaaccgaagaagtcaacggtataacccacaatggcgcttgcagcgacagaaccgcccaggtaaccaaacagaccggtaaagcccgccgccgtacccgccgcttttttcggcgccagttccagcgcgtgcagaccgatcaacattaccgggccgtagatcaggaagccgatgataatcatacaagccatatcaacgttcgggttccctgctgggttcatccagtaaacgatggtcgcgatagtcaccagggtcataaagaacacgccggtcgcgccacggttgccgcggaagactttatccgacatccagccacacagcagcgtgcccggaatacccgcgtattcatacaggaagtaggcccaggaggatttatccagtgcgaaatgcttcacttctttcaggtaggtcggcgaccagtcgagaataccgtagcgcagcagataaacaaacacgttggcgatagcgatgtaccacaacagtttgtttggcagtacgtactgcatgaagatctgcttcgcagtcagctcttcttccgctttttcgttgtagtcgtccggatagtcgtttttatactcttcgataggcggcagaccgcaggattgcggcgtatcgcgcatcattgcgaaagcgaacagcgccaccacaatcgcgccaaaggctggcatatagagcgccgctttccagtcgttaaaccaagccatccccagcaggaacagcagtggcgggatcccgccgccgacgttatgcgcgcagttccagaccgacacaatgccgccgcgctctttctgcgaccaccagtgaaccatcgtacgaccgcacggcggccaccccatcccctggaaccagccgcaaaggaacaacagtacaaacatcacggcgatgctggatgtcgcccacggcacaaagcccataaacaacatgactgctgcggccagaatcaaccctgccggcagaaaaacgcgcggattcgagcgatcggacaccgaacccattataaatttcgaaaaaccataagcgatggaaatcccggacagcgcaaagcccagatcgccgcgtgaaaaaccctgttctaccaggtagggcatcgcgagggcaaagttcttgcgcaccagataatacgcggcatagccaaagaatatccccaggaaaatctgccagcgtaatcggcgataggtcggatcaatctccgccgctggcaagcgcgctttatgcggcgctggtttaaaaatactcaacatattgtagcctccgtggcccatattttatttagaggtaaacaccgcagttcgttcaaacaaccccgctgctcccagtgtggccgcgatgttaagtaaagatacgtcacgttaatgtgaattacagcacatattgttacagatttatgactaatgttcagaaaggcgcacgaaatcacgtttcattttcgaatagtgagcgattatgcgcgaaatcaaacattccatatgatttgtatggctaaatgataaaaaacgaactgtgaggaaaaacaatgaaaactcgcgactcgcaaacaagtgacgtgattatcattggcggtggagcaacaggcgcagggatcgcccgcgactgcgcgctgcgcggtttacgtgtcattctggtggagcggcatgatatagcgaccggcgcgaccgggcgtaaccacgggctgctgcacagcggcgctcgttatgcggttaccgacgcggaatccgcgcgcgagtgcattagtgaaaaccagattttaaaacggatcgcccgccattgcgtcgaaccgacggatggtctgtttattacgttgccggaagatgatcttgcgtttcaggccacctttattcgcgcctgtgaagcggcaggcattcgcgctgaagccatcgatccgcagcaggctcgcatcatcgaaccttccgttaaccctgcgctcatcggtgcggtaaaagtgccggatggcaccgtggaccctttccgccttaccgccgccaatatgttggatgccagagaacatggcgcaatcgtgttaacggcgcatgaagtgaccgggctcattcgtgaaggcgcaacggtctgcggcgtccatgtgcgcaaccatctcactggcgaaactcagacgcttcacgcgccggtggtggtcaatgcggcaggtatctgggggcaacggatcgccgaatacgccgacctgagtattcgcatgttcccggcgaaaggctcgctgttgatcatggaccatcggatcaaccagcatgtcattaaccgctgccggaaaccatcggatgccgacattctggtacctggcgatacgatttcactgatcggcaccacctctacccatattgattacaatgagatagacagcaaccgcgtcaccgcagatgaagtcgatatcctgctgcgtgaaggggaaaaactggcccctgtcatggcgaagacgcgtattctgcgcgcgtattccggcgtccgcccgctggtggccagcgatgacgatcccagcggtcgtaacgtcagccgcggtattgtgttgttcgaccacgccgaacgcgacgggcttgatggcttcattaccattaccggcgggaagctaatgacttaccgcctgatggcggaatgggcgaccgatgccgtgtgccgcaagttgggcaatactcgcccctgcatcacggcggatacgccgttgcctggctcaaaagagtctacggaacatacgctgaaacgcattatctcgcttcccgcgccgctacgcggatcggcggtttatcggcatggcgatcgcacgccggggtggctgagtgaaggccgccaacaccgtagcctggtctgtgaatgcgaggccgtcacggcgggggaagtgcagtatgccgtcgaaaacttaaccgtgaatagcctgctggatctgcgccgtcgcacccgcgtagggatgggcacttgccagggcgaactgtgcgcctgccgcgcggccgggctattgcagcgttttaatgtgacgaccgcggcgcaatctattacgcaactctctgaatttctgaatgagcgctggaaaggcgtacaacctgtcgcctggggagacgcgctgcgcgaaagcgaattcacgcgctgggtttatcagggattatgcggtctggagaaggagcaccaggatgaaatttgatacggttattatgggcggcggtctcgccggtttgctatgcggactgcaactccagcagcatggattacgctgcgccatcgtcacccgcggacaaagcgcgctgcatttttcctccggctcgctggatctactcagcgccctgcccgacggccaaccggtgactgacattaccgccgggcttgatgcgctgtgccgccaggcgcctgaacatccttattcgcgtttaggcgcgcaaaaagtccttacgctggcgcaacaggcgcaaacgctacttaacgccagcggcgcgcagttatacggtgacgtacagcaggcgcaccagcgtgtcacgccgcttggcacattgcgttcaacctggcttagctcgccggaagtaccggtctggcccttatccgcacagcgaatttgcgtcgtcggcgttagcggattactggatttccaggcgcaccttgcggcagcgtcgctgcgccaacgcgacctcaacgtggaaactgcagaaatcgaccttccggaactggacgtactgcgtgataacccgacggaatttcgcgcggtcaatattgcgcgtctgcttgataacgaagaaaaatggccactgctgtacgacgcgctgtcgccaatagcgacaaactgcgacatgatcatcatgcccgcctgtttcgggctggcgaacgatacgctgtggcgctggcttaacgaacgtctgccctgcgcgctcacgctgctgccgacgctgccgccatcggtgctcggtattcgtctgcacaatcagctccagcgccagtttgtccgtcagggcggcatctggatgccgggcgatgaagtgaagaaagtcacctgccgtcgcggtaccgtgagcgaaatatggacccgcaaccatgccgatatcccactgcgcccgcgttttgccgtacttgccagcggtagcttctttagtagcggtctggttgccgagcgcgaagggatccgcgaacctattttagggctcgacgtacagcaaacggccacccgcgccgaatggtatcaacaacatttcttcgacccacagccctggcagcagtttggcgtcgtgacggatgacgctttccgcccctcccttgcgggcaacacggtagaaaatctgtatgcaataggttctgtgctggcgggattcgatcctatagctgagggatgcggcggcggcgtctgcgcagtcagcgccctccaggccgcgcaccatatcgctgagcgtgcaggagaacagcaatgagcgacacacgttttgaaagttgtataaaatgtacggtgtgcaccaccgcgtgcccggtcagccgcgttaatcctggctaccctggccctaaacaggccggaccggatggcgaacgcctgcgtctgaaagacggcgcgctgtatgatgaggcgctgaaatattgcattaactgcaaacggtgtgaggtcgcctgtccgtcggacgtgaagattggcgatatcatccagcgcgcccgcgcgaaatacgatacgacgcgcccgtcattgcgtaactttattctcagccataccgatctgatgggcagcgtttcaacgccgttcgcgccggtggtcaataccgccaccgcattaaagccagtgcgccagttgcttgattacgcgctcaaaatcgatcatcgccgcaccttaccaaaatactctttcggcaccttccgccgctggtatcgtagcgtggcggcgcagcaggctaaatacaaagatcaggtcgcctttttccatggctgttttgtgaattacaaccatccgcagctcggaaaagatctgattaaggtgctgaacgcaatgggtactggcgtacagttactgagtaaagagaagtgttgcggcgtaccgctgatcgctaacggttttacggataaagctcgcaaacaggctatcagcaatgtggagtcgctacgcgaggcgattgccgtcaaaggtattccggtcatcgccacgtcatccacctgtacgtttgcgttgcgcgatgaatatcctgaagtgctggacgtggacaacgccgggctgcgcgaacatatcgagctggccacccgctggctatggcgcaaactggatgcagggaaaacgctgccgcttaatcctttgccgctgaaagtggtctaccatacgccgtgtcatatggaaaaaatgggctggacgctttacacgcttgaactgttgcggcaaattccggggcttgaattgacggtacttgattcacagtgctgcggcattgccggtacgtatggatttaaaaaggaaaactatccgacatcacagtccatcggcgcgccgctgttccgccagattgaagagagcggcgccgacattgtcgtcaccgattgtgaaacctgtaagtggcaaattgagatgtctacaagcaaacgctgcgaacaccccattacgctactggcccaggcgctcggctaagtaaaaagcgccggagcccctccggcgccattaccctactcaccagggacgattttccatcagacatatacccttcatacttcaagttgcttatgtgttggctacggattattttgggtataaacgcggatgtctctttgcaataacctgccctatttggttaaccatgaccgctaacccacggtggcatgacagataacgacgttactgtttatagagcaatatctcttgtatcgacgcgttaccagccacctttaaagagggggataactgaatatccccaataataattgagtgttatgtgaataataagaaaatcaggtctatgcctgatttaatatatcccccgctaataataatatttttacaaataattatacattacatcatattcgctactttcacttaccaggaaacagagcaaaatgaatatatgtgtaaattcactttaccgattgagcataccgcaatttcacagcttatatacagaagaggtgagcgatgaggcgcttacattgttgtttagcgccgtagagaacggtgatcagaattgtattgatctgttatgcaatcttgcgttacgcaacgatgacctggggcatagagttgagaaatttctttttgatctctttagcgggaaaagaacgggatcatcagatatagacaaaaaaatcaatcaggcttgccttgtattacatcaaatcgccaataacgatataacaaaagataatactgagtggaaaaagctacatgccccttccagattactttatatggcaggttccgcgacaaccgacctttctaaaaaaataggaatagcacataaaattatgggcgaccagttcgctcagacagatcaagaacaggtaggagttgaaaatctttggtgtggtgcgcgaatgttgtcgtcagatgagctagcagctgcaacgcaaggtctggttcaagaatcacctcttctctcggtaaactatcctattgggctgattcatcctaccaccaaagaaaatatattaagcactcagctacttgaaaagattgctcaatcaggattatctcacaatgaagtcttcctggtaaatacaggagatcactggcttctctgtttattttataaacttgcagaaaaaataaaatgccttatatttaatacttattatgatttaaatgaaaatactaagcaagagattatagaagcagcaaaaattgcaggcatatcagaaagcgatgaggttaattttattgaaatgaatttacagaacaatgtacccaacggctgtggtctattttgttaccatacaattcaactcttatcgaatgccggacaaaacgatcctgctaccacactacgagaatttgcggaaaatttcttaacgctttcagtagaggaacaagcactatttaacacccaaacccggcggcaaatatatgaatacagtctccagtaatggtgagtacttagagcctatcccattaggctcttatcctgaaatgatgctctgcgaagaatttataagtatataagggtgggaaggccaggccttcccactaaaagttctatgccgtcaatgattcaaccacgtctatccagccatgctcgctggtaatgtcctcgccattaagccaacggcgcagcatatttagcgccatcaccgcacaaacctcctgacgtattgccagactataccgataggcgctaaaacgcatgcgtaaggcatacgtgccatccggcatttttctcaataactacgttttgccgtgcttactgactgaacagatttaaacatcgccaacctgctgtccagcgcctcggtgtagagcatcgtatctaccccgaccgcgacaaaattcgcgccccacgccagacatttctgcgccattgccggatcgaccgccaaaaaacccgccgcttttccggcggcgcgaatacgataaatacacgcttcaatgattcgctgcacttccgggtgtccggcattatcggggtaacccaatgaagcagagagatctgccggaccgataaagacgccatcaatgccttcaacctccagaatcgcgtcaaggttttccagcgccactttgctttcaacctgcaccaacaggcagagcgactcattggcctgtgccatatagttgtcgattctcccccagcgcgccgcacgcgccacgctcgcgccaacgcctcgttgccccaacggcgggtatcgggtagcggaaacgacctggcgcgcctgttctgcggtgtcaaccatcgggatcagtagcgtttgcgccccgatgtccagtacctgtttaatgagcgctttacttccctcgatcgggcgaatcaccggctggctggcgtatggggcgatggcctgtaactgatgatacaagtcctgcaccgtattaggcgcgtgctcgccatctattaacaaccagtcataacccgacgtcgccgcaatctccgccatataagaggtggttgaactgagccacaaaccaatttgcgtatcccctttacgtaatccttctttaaaaggatttgataacaatgcgttcatagcgatccttacaacgtagataagattaatgatgcgcagcgccggattgcgccaccggacgattaacgctcagcgtgaagataattaatgagccaatgatggcgactccggccagcgtcagcaggcccgccgcatcgctggcaaacaacgtttccgcttttacgcgcagaattggggcaataaaaccgcccacagcgccaaacagattaacgaaaccaattcctgccgccagagccgtaccggaaagtagctgcgttggcatggtccagaatacgggctgaacggcaataaatcctactgctgcaacacagagcgccagaatagcgagcaccggagaaaccagacctgacaggccaatgccaatgcccgcagccagtagcgtcactgccgcaacgttacggcgatcgccggtacggtcggagtagcgaggaataagccatgtgccaagcaaagccgccacccagggaaccgctgttaccaccgaagcggtaaagcccactttagtgcccaatagcgcggcaacctgggtcggcaggaaaaagatgagtccgtataccgccacctgaatcgtcagataaataatagccagttgccagacgcgtccattacgcagcgcatccgcaagccttgacgtgacctttttctcttcttcgctcgccagttgcctgataagcgcgttcttttcttccaggctaagaaaacgcgcctgctgcggagtgtcatcaagccagaaaaaggtgaatatccctgcgccaatcgccagtaggccttcgataacgaacatccagaaccatcccgggtgccccataaaaccatgcatctccagcagagcgccggagagcggcgaacccaacgttaacgccagcggcgcccccatataaaatagccccataatgctggcacggttacgctgcgggaaccattgtgaagttagatagatcatgccggggaaaaatccagcctccgccgcgcccaatagcgtgcggattatcagaaattttgcttcactatccgcccaggccatcgcagcagagagaaagccccacagcagggtagtcgtgccgatccaggttcttgcgccaaatttgcgcatcagcaggttagccggtacgccaaggaaagcgtaaaccacaaagaaaataccggcccctagcgcgtaggcttcattacttagcccggtatctatctgataggtctctttggcaaaaccaatatttgaacgatccagaaacgccagtacatacagcgccaacataaaaggaattaaacgtgcgcggtttttcttcactacgccgtcaagtaaagtgatgctcatagcaatatcctcaacaggatgagggcgttgccgtacaaaggcaacgcacgagttattagtggctataagggcgtttcaagtgacagtcacggttaagctcgacgccgaagcccggcttatccagcactgatttatggatgcgtccattcaccggcaccggctcatccaggagaatcgggtcaaattgcggacgcagagtggagcagtccgggctggtcatcaggaactcgctgaaaggggtattagtgaaagtaataactgcatggtgcgaatagacagacgaaccgtgcggcaccaccagttgcccgcgcgatttggcaagcgcggcgatctcaaccagcgtggttaatccgccgcaccagccaacatccggctgcataatatcaatgccggtttctgccagagtgcggaaggattgcagcgtaccatggtgttcgccgctggtaaccatcatccctgcaggcgcgttgcgttttaattcgcgatagccttcatactgctgcggcggcagacactcttcaatccatttgagattaaatggcgcacaggcgtgagccagtttagtcgcatagttcacatcctgactcatccagcagtcgagcatcagccagaaatccggcccgcacttttcacgcatatccgccaccatcgcggcatctttacggatccccgcatcaccatcgtgcggtccccagtgagtcggcattttaccgccgataaagcccatttctttagccagatccgggcgtgcgccggtggcgtaaaactgaatttcatcgcgcaccgctccgcccagcaatttataaaccggcagcccaaccaccttgccaaacaaatcccacaacgccagatccacacaggaaatcgtgttcatcaccagaccgccggaaccggagtagtacatggtcgcgccgagcatctgatcgtgaataagtttgatatcgcttacgcatttgccttcaataaaccggttaagatgtttttctacgataaaacagcccatctcccctgctgtcgaaacggcgaaccccgtctgcctattttccgcctctacttcgacaatcagcgtccctaacacgttgatcccaaaagactgacgagactgctcatagtcgcgatatttgctcatgggagtggcgatatggtcatcaatccagtgatttcctccctggtcgtgataatccccgccgccagcccctttctctgcggtagcgcccccaataaaccaggctcgaacgtgtttaattttaggaagagtcataatattctccattttaagatgcgagtgagtcgaagggacttttccatcccaacaggcgtgaaatatctttggcacaggcaatagctttaccggccaaataatctagattctcttcgttgatttgcaggcgcgtgccgaccactgaaattgccgcggtcagttcgtttctggcattaaataccggtgcggcaacgcagcggacatccggataatcctccccgttatcaaagctccatcctcgctggcgaatgcgctccagctcatcattcaattgttgcggctcggtgatggtggtcagcgtggctcgctcccataccagttgttcaataatggctttgcgtacggcggccggctgccatgccagcaggcatttgccgatgccggaacgataaagagagaggcttttcccctcatgcgagcgcacgctgatagtggatgaggattccactttcagtatgtaatacgcattttcgtggtcgatgatccccaagtgacacagcagcccggtttcatccatcagttgtgttagacgaggacgcgccagctcccgcagatccatcttgctgagcgcatgacccgacaattcaacgagcttagtccacaggcagtagttatcctgatgatcgaggctaataaatcgctgacgttttaattcattcaacagcaggtacgcggtgctttttggaatacgcagcgtttcaataatgattgccgcgctgcatgggccaatacgcgcgatcaaattgaggatgtcgattgcgcgagtaagagccgggactttacttgattccaacatattggactccagtctgagacactggaatcagtgtgaaaggtcagtagggaaaaaattgtgaagcgcgtcaaagcttatccgccttccaacggagtggaagggttaaccatataaatgtgaattaacgcacgtattactttgtattcagtacaattggctggacaaaaaagcagatgatattgccggataatggcatagcggccttatccggctcacgatgtcgttcccatcgcagataagagaaagggattatgatgtcaatgattcaaccacgtctatccagccatgctcgctggtaatgtcctcgccattaagccagcggcgcagcatatttagcgccatcatcgcgcagacctcctgacgtattgccaggctataccgattggcgctaaaacgcacgcgtaaggcatacgtgccatccggcgtcgccagcgcgaaattaagatgttcgttttccagccccgacacggccagcgccagaccggcataatgattgctgcgccgttctgtcgtccagtgtgccgtttgcgccagcgtctcttcctgagaaggaacgacttcgctggcaagaacaggcgccccggcgcgggaaagctgtagcgccagtaagccgctggtgtattgctcgctcaacgtcagactcaactgcctttcctgcaggcggcgggctatttgcgccggcaggttttccgtaccttcaaaaatcaggttctgcccggcaacccgtttgacctctggccataacgccagcatcgcctcccgttgcgtcgccgggccggtcaatttcagttcaatgatcggcattgatgagcgataccccatcgtcacgccgggcggcaacggcagtgaatcgagacgctgcgcgaggtcactttctgaacgtccaaaagtcgttaaccgcaggcaaagcggcggctccggcagcgaaaaacgcgcgcgtaaccgcggtaagatttccttctccaccataaccttaaattcagacggtacgccgggggtgaaaaacatcaggcagcggttgagctgtagcgcaaatccacaggcagtgccgagcggattattaataaactccgcgctggcaggcagttccgcctgtttacggttgctcggcgccatcacgcggccacgctgctgaaagtagcgttccatttcggtcagccacgcctggtgcagtactaatccttcgccttttgccgttgccgcggcgagcgcgcttaaatcatcgctggtcggccctaacccgccattaacaatcaaaacatcagcatgttgactgcgttcacgcaagatagcgaccagactgtccagattatcgcctaccgtatttcgccgtgataacggaacgccctgatgaaagaaaaaatcagccagccaggcggcattggtgtcaacgatttgtccgtgcaacacctcatccccggtggatagcatttccacatttagcattgtgttctcctgctcttatgatgaaaacactataacgcaaagacgaatatgacgtggaaagaagaatgacgggaacaggaggaatatggcgcgacgattgccgcgccgttagcatcaaaagctggcgtttacgccaacataagggccgtcagcaatcgcattatcgcggttgccgtctttacccgccaggttcaggtaacgataaccggcttcaatgctcagcgggcgcataatggtgaaacgcgcgcctgcattcgcttcttcataactgtcgataccgctggacagcgaatctggtgaataataatactcgccgaacagacggaagctgttgccgattttccattgtagcccaccgccgacagccgccgcatagccttcatcgctgtctttcggattggtataaatacctttaccgccgaccgtcgccagcagcggtcccaccggaatgttcagccccagacccacgcccgcagcatcgccatcatcatcgttgtgcatccagttgccgcttagcgccagtcccgtcgattccgtaccaaaacccacgccaatgttggtgtaatcttcgcccgcctggccgctaatactgatggcctgcgccgatgcagaaacgaacagcattccggcaaaacctaataatatgctttttttcatttttaccctttccagcaagcacataaagaaaaactccccaaaacggcagaattgtactgccagacgctgaggaatcaatgcactaagaaaccattccaaaaacatattgtaacgaaatactactttcgccatgacgcatcattgcgccatcacatggcgacgcctgcatcaacaaaattaacaaaaaacgcagtctgcgttatcgcttccatttttcacaaagaatttcgcagaatgatttgttaagctgatggcctggtggtttaaggaagcgacttatgcgtcaacgaactatagtttgcccattaattcaaaatgatggctgttatctgctgtgcaaaatggccgacaaccgcggcgtctttcccggtcagtgggcgctgtcgggcggcggggtcgagccaggcgaacgcattgaagaggcgctgcgtcgggagattcgggaggaactcggcgaacaactgattctgagcgatattacgccgtggaccttccgcgacgatatccgtattaaaacctacgctgatggcagacaagaagagatttatatgatttatctcatcttcgactgtgtttccgctaaccgcgatatatgtattaacgacgaatttcaggactacgcctgggtcaagccagaagaactggcgctgtatgatttgaatgtagcgacacgccacacattagcattgaaagggttattataatgacgacagccgcttcaggctgtctttacgcttttaacatgcggctagccgggaacaaattcaccatctaaaaagagttttccgttttccgcatgcataacgagcgcattaagatagtccggatcaaactttacgccgcgcttattttttgcaatatacgtcaaacaatgattatgggtaaaaatgactatatttttattctgcgactttttcagtaacgtattgattgaagcataaataccgctgccgcaatccatcatttttttatccaccgtaagcgacctgcccgcagaaaaccaggttgccgactggatggtgcgcaccgtattactggaatagagattgtaattttgtatatcggcactgaaggctttacccagcgctctggcatcttgcgcacccttgaccgtaatccccgtgctgtctgacaggcaggtattatcggaacgatcgcaccgctcggcatggcggaataacacgactaccggatgctgcttcgccagcgccgccagcgctttaccgttaatctgcggtagaccgttaccactccaggcatgttgtgaggtcaacccggcgataataaccaacgcccccgccagaatcgcgaaatagcgtttgtttttaataaagcgtagggtaaatgccagcacattaacctctcaggcagacagtgcagctaacttaatagcaatacaattaaaatgaaattccgcaacggaagaccaggccagaaacataaaaacagcttttgggcatgcataaaatgccttaaactttcggcgaaagcaaagcataattccgttaaaaattatctttttacttcaccttaatttcttaatgttaatttaatcttcatccagtagggttcagctaaatgcgttaaaaaataagcccttttctattgccgaaatatttgaaaagcggctttcaatggctgaaggaaaaatgatgtcggactttttgcctttctcccgtccggcgatgggcgcggaagagcttgctgccgttaagaccgtactggactcaggttggataacaaccggcccgaaaaatcaggaactggaagcggcgttttgtcggctaactggcaatcaatatgccgttgccgtcagttcagccactgccggtatgcacatcgcgttgatggcgctgggcattggtgaaggcgacgaggtcattacaccgtcaatgacgtgggtttctacgctaaatatgatcgttttactcggcgcgaaccccgtcatggtcgatgtcgatcgcgatacgctgatggtcacgcctgaacatatcgaagccgcgattacgccacaaaccaaagcaattatccccgtccactacgctggcgcgcccgccgatctggacgctatttacgctcttggcgagcgttatggcattccagtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcgggggacgcgcgccacaagcggaagtcctggcgccgggctacaaatataatttgcccgacctcaacgccgctatcgcgcttgcccagttacagaaactggatgcgcttaacgctcgacgcgccgccatcgcagcgcagtaccaccaggcaatggcagacctgccttttcagcctctgagccttccgtcgtgggagcatattcacgcctggcatttattcattatccgggtcgatgaagcccgctgcggtattacccgggatgctctgatggcatcgctgaaaacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgagtcattaccgcccttcatcagatagcaggacaataagcatgtttgacgccgcccccataaaaaaagtctcggtggttattcctgtctataacgaacaggaaagcctgccggaattgataagacgcaccaccaccgcctgcgagagcctgggcaaagcgtgggagattttattgatagatgatggtagcagcgatagctcggcggagctgatggttaaggcgtcccaggaggccgatagccatatcatctctattttactcaaccgtaactacggtcaacatgcagcgattatggcggggtttagccatgtaagcggcgatcttatcattacgctggatgccgatctgcaaaacccgccggaagagatcccgcgcctggtggcgaaagccgatgaagggttcgatgtggtaggcaccgtgcgccagaaccgacaggacagcctgtttcgcaaatcggcgtcaaaaatcattaatctgctgatccagcgcacaacgggcaaagcgatgggcgattacggctgcatgttacgcgcctatcgccgccctattatcgatactatgttgcgctgccatgaacgcagcacctttatccctattctggccaacattttcgctcgtcgggctaccgagatcccggtgcatcacgctgaacgtgaatttggcgactctaaatacagttttatgcgtctcattaacctgatgtatgacctggtgacctgcctgacgacgacgccgctgcgcctgttgagtctgctgggcagcgttatcgccatcggcgggtttagcctgtcggtattgcttattgtacttcgcctggcgctggggccgcagtgggcggcggaaggcgtatttatgctctttgccgttctgtttaccttcatcggcgcgcaattcatcggtatgggactgctgggcgaatacatcggtcgcatttataacgatgtccgcgcccgcccccgctattttgttcaacaagttatctacccggaaagcacgccgtttactgaggaaagccaccaatgaaagccgttatttttgcctatcacgatatgggatgtcagggggtgcaggccgtactggatgccgggtatgagattgccgcgattttcactcatgccgacaatcctgcggaaaacaccttttttggctccgtctcccggcaggcggcagaattagggattccggtttatgcaccggataacgtaaaccatcctatctgggtcgaccgcatcgctgagcttgcgccggatattattttttcgttctattaccgcaacctgttaagcgaagaaattctgcacctcgccccggctggcgcgttcaatctgcacggttctctattgcctgcctatcgtggccgtgcgccgctaaactgggttctggttaacggcgaaagcgaaacgggcgtaacgctgcatcgtatggtcaaacgtgccgacgccggagagattgtcgccagtcaacgcgtcgctattgcgcaggacgatgttgcgcttaccctgcatcataagctatgtcaggccgcgcgccagttgcttaatagcatcctgcccaccatgaaatgcggcgatataccttctgttccccagcgtgagtctgactctacgtattatggtcgccgcaggccggaagatggccttatcgactggcacaaaccggtttccacggtgcataacctggtgcgggcggtagccgccccctggcccggcgcgttcagctataacggctcgcaaaaattcactatctggtcttcccgaatgtgtccggatgcgcaaggcgcgcttcccggctcggtaatttcggtctctccgctgcgggtcgcctgcgccgatggcgcgctggagattattaccggccaggccggagacgacattactgtacagggctcgcagcttgcacagacgcttggtctggtggcgggcgcgcgtttgaaccgtccaccagcgaccagcggtaaacgtcgcattcgcgttctcatcctcggcgtcaacggttttatcggcaatcatttgaccgaacggttactgaatgaagagaattacgaggtctacggtatggatatcggcagcaacgccattagccgattcctgctccaccctcgatttcatttcgtggagggagatatcagcatccactcagaatggatcgaatatcatgtcaaaaaatgcgatgtcgtactgccgctggtagcaattgcaaccccgattgaatacacccgcaacccgctgcgcgtctttgaacttgattttgaagaaaacctgcggattatccgttattgcgtgaaataccgtaaacgcgtggttttcccgtctacctctgaagtgtacggcatgtgtacggacgcctcttttgacgaagacaaatcgaatctgatcgtcgggccggtgaataagccgcgctggatttactccgtttccaaacagcttctcgaccgggtgatttgggcttatggcgaaaaagagggattgcgcttcacgcttttccgtccctttaactggatggggccgcggctggatagcctgaacgcggcgcgtatcggcagttcacgcgcgataacgcagttgattctgaacctggtagaaggaacgccgatcaagcttatcgacggcggtcagcagaagcgctgttttaccgatattcgcgatgggatcgaagcattattccgcattattgtgaatgatggcgatcggtgcgatggcaaaatcattaatatcggcaatcctgacaacgaagccagtattcaggaactggcgacgctgttgctcgacagttttgataagcatccgctgcgctgccatttcccaccgtttgccggtttccaggtcgtcgaaagccgtagttattacggcaagggttatcaggatgtcgcacaccggaaacccagtatcgacaatgccaggcgctgtctgggctgggagccgtctattgcgatgcgtgatacggttgaagaaacgctggacttctttctgcgtagcgtcgatatcgcggaacgcgcatcatgacgaaagtcggtttacgcattgacgttgataccttgcgaggaacgcgtgaaggtgttccccggctgctggcgacattgcatcgccacggcgttcaggccagctttttcttcagcgtcgggccggacaatatgggacgccatctttggcgtctgataaaaccgcgatttttatggaaaatgctacgttcaaacgccgcttcgctctacggctgggatatcctgctggccggtaccgcctggccgggaaaaaatatcggcaacgctaatgccgggattattcgtgaaacggcaacataccatgagacgggactacatgcctgggatcaccatgcgtggcagactcacagcggccactggagtatccgccagcttgaagaagatattgcgcgcggcataacggcgcttgaggccattatcggaaaacccgtcacctgctcagccgcggccggctggcgagcggatgggcgcgttgttcgtgcgaaggagtcgttcaacctgaggtataacagcgattgccgtggaaccaccttattccgtccgctactgatgccgggccagacagggacgccgcaaatcccggtcaccttacccacgtgggatgaggttatcggccccgccgttcaggcgcagtcgttcaatacctggattatttcccgtatgttgcaggacaaaggcacgccggtatataccatccatgcggaagtagaaggtattgtccatcagccgctgtttgaagatttgctcgttcgtgcacgcgatgcggggatcaccttttgtcctctgggcgaactgctgccggcatcgcctgagtctctgccgttggggcaaattgtacgtggacacatccctggccgtgaaggttggctggggtgtcaacaggcagcgagcgcctcatgatgaaatcgatacgctattatctggctttcgccgcgtttatcgcgctctactatgttattcctgtcaacagccgcctgctctggcagccggatgaaacgcgctatgccgaaataagtcgggagatgctggcgtctggcgactggatcgtgccgcattttctgggattacgttattttgaaaaaccgatagccggttactggataaacagtctgggtcagtggctttttggcgctaccaattttggcgtgcgggctggcgctattttaacgacattgctggccgcagcgctggtggcatggctgacgttccgcttatggcgggataaacgtaccgcgttgctcgcctccgttatctttctctccctctttgccgtttacagtatcgggacgtatgcggtactcgacccgatgatcgccctttggcttacggccgggatgtgttgtttctggcaggggatgcaggccacgacccgaatgggcaagattgggatgtttttgctactgggcgcaacctgcggtctgggtgtattaactaaaggcttcctcgccctggccgtacctgtggtgagcgtgctgccgtgggtcattgtccagaaacgctggaaggactttttgctttacggctggctggcggtcttgagctgctttgtggttgtccttccctgggcgatcgccattgcgcggcgcgaagccgatttctggcattactttttctgggtggagcatatccagcgattcgccatgagcgatgcccagcataaggcccctttctggtactatctgccggtactgctcgcgggaagtttaccgtggctggggttactgcctggcgcgcttaaactgggctggcgcgagcgaaacggcgcattctatttgctcggatggacgatcatgccgcttctctttttcagcattgcgaaagggaaactgcccacctatgttctttcctgtttcgcaccgatagcgatactcatggcgcgcttcgtcctgcataacgtaaaagaaggcgtcgccgcgctacgtgtcaacggcgggatcaacctggtgttcgggttagtcgggatcgtcgcagcgtttgtcgtctcctcatggggcccgctgaaatcgccggtgtggacgcatatcgaaacctataaagttttttgcgtctggggcgtctttactgtttgggcgtttgtgggctggtatagcctctgtcatagccaaaaatacctattacccgcgttttgtccgctgggactggcgctgctgttcggcttttccatccccgacagggtgatggagtccaaacagccacagttttttgtcgaaatgacccaggcgcctttggcatcaagccgctatattcttgccgacaacgtgggcgtcgccgccgggctggcctggagtctgaaacgagacgatattatgctctacggacacgcgggcgaactcaggtatggtcttagctatcctgatgtgcaggataaattcgttaaagccgacgattttaacgcctggctcaaccagcatcgtcaggagggcattattacgctagtactttcaatagccaaagatgaagacatcagcgctctttcccttccccctgcggacaatattgattatcaggggcgtctggtgttaattcagtatcggcctaaatgatcggcgtcgttctggtgcttgccagtctgctcagcgttggcggtcagctctgccagaagcaagcgacacggccattgacggcgggcggacgccgccgtcacctgatgctgtggctgggcctggcgctgatatgcatgggcgcagcgatggtgctgtggctgctggtgctacaaaccctgccggtgggaattgcttacccgatgttgagtctgaattttgtctgggtcacgctggcggcctggaaaatctggcatgaacaggttccgccccgccactggttgggcgtcgcattgattatcagcggcattatcattctggggagtgcggcataatgggcgtaatgtggggactgataagcgttgcgattgcctccctcgcccagttgagtttaggattcgccatgatgcgactgccatcgatagcgcatccactggcgtttatttccgggctgggcgcatttaatgccgcgaccctggcgctattcgccggtttggcggggtatctggtttccgtcttctgctggcagaaaacattacacacgctcgcgctcagcaaagcctatgcgctactgagtctcagctatgtgcttgtctgggtagcctcaatgctgttacccggtttgcaaggcgctttcagcctaaaagcgatgctcggcgtattgtgtattatggcgggggtaatgctgatttttctgcccgccagatcatgatggcttgcgcgtcaaccgctgccattcgtcgcaggaataacagcgtgcatcaacgatttttaaggtctggtgtttttcccgattaatacaatactgcgcatcctgtaaaggcgacaggatatcgccgggactcagtaatatcatggaattcgcctcggcgatcatttttagcgaaccgccgctatcgcacagcaccagaacatggcacgccctctttttgacataatgcgatttcttaaccaaccattccatagcgcccccgtttcacgctgattgttcataacacgttacacatcaacggataaacaaaacggcaatagcgatggaatggttgtatattaacctaacattaatttttacagttctcacacacccactgctggagcgcacggcgagatattttaatccctccgtttttcagttctgacggcatcgtcaaccagcgaaccggctgttgaaaacgcgccagcttatcacgaacccattcagcgaggttcacgtctccggcctgcgatgcatactccacaaccgcaacgggacgatgaccaaactctttatcttctaccggcacgacgaaggcttgttgcaccagcggatgcgcattaataacgcgttcgacttcctccggctgaatgccttcgccgccgctaaagaacaggttgtccagccgcccggcgatggttagcctgccgtggttcagctcgccgcgatcgcgcgtggcaaaccagccttcgtcattaaccagcgggatcagtttgccatcacgccagtaaccttccgccatactggcggcgcgcagccagacttcattatcgacgattctgatctctctgccgggaagcggcgcgccaacatcatccgaaccatcggcctctttggcgcataccgtagacgcgaactccgtgagcccatacccgcaccagcagcgaatcccttgtttgctggcctggtcggtgagttcaaccggaatcaccgcgccgccgagcaaaacggctttcagcgtcaccgccgcccgattcgccagcagccgccacagctgcgtcggcaccagcgaagcatgagtacaccctgccagcatctgctccagcggttgcttatcgcgtaccgtcatgcgcgccccggcgaagagccaacgccacataataccctgcccggatacatgaaacagcggcagcgatagcagccagtcatcctgagggccaaacggcattagcgaaagcaccccctgcgcgctggcaagatgcgcctggcacgtatgtacagccgcttttggcaatcctgtggaacccgatgtcagcgtcatggaaaccagacgctgcggttgccaggccacagcatacgccgctgtactcttttgtatctgcaacgcggttaatccagaaaacgcattttcgccttccagtgtcagcgcaaaacgcagcgttaacttcggcaccagcgcctccagcaatgtctggggcaactgcgggttgacgggcagaacccgcgcgccgcactgcatcagcgcaagccatgccaacagagtgcgcggctgattcccggcgcgcagcaggacaccatcgccctcgcgtacgccctgcgcggcaaacccgcccgccagcacatcaatacgctcacagagggcgcgccagcttagcacttcatcgttcaggcgcagagcgggcgcctgactgcgaacctgacgccagtggcgccacggccaatccgtgaatgtcataacagtcgttccagctcctcacgcttcagacaaggcaacgcgctaccgggccaggggcgaatctgttgcgcctgcatcagatgcaaggtatccagtccaggcagcgttcccggcgtcaaccaggcggcaatccgcgccagttgcgtcaggccgaggctggactcgatcgaagagctgatgaccgccgtcagtcccaacgcatgggcggcagcgacttgctcacgcactttatcaagcgatccggtcagcgtaggtttgataaccacagccctgacgccctcttcggcttcaaaggtgaaatccgcttcgcgcagactttcgtcccaggcaatcgcgatgccggtttcacgggcaaaggcgcgggaatcatcccgcgtcttacacggttcttcgagaaaggcgatacgagcgcggtaatccggattaacatactttgcaaactgttgggcttttagcggcgtccaggcgcgattcgcatccagacgcagatgcagatccgggatcgcctccagcagcaaattaaccaccatgccgtcgcgtaccgcttcataaagacccactttgaccttagcgattttctcgccgggcatatcggcaagccgcagcaccaaatcgtcaggatcgccagtgcataacggcgcggcgcgatagtccgccgcctccggcaagacgccagtcagttccgccagcgcgcagcttgcgccaaacgcgaccgaaggcatctcgggtaatccctcgctcccctgaagccagtcgttcacccatgttagtagcgccgtctgcgcctcttcccacgtttcctgactgaagcccggcagcggagagatctctccccatccctcacgctcgccgtcacgcagacaaacatacagcccgtcgcgagtttttaaccgcctgtcgcgcagaaccacccccgcgtccatggggatctgccagcggtatacctgcgcgctacgcattatgggttccgtttgaatttgctgaagtcaggctgacgcttctggttaaaggcgttacggccttcctgcccttcttccgtcatgtagaacagcatggtagcgttgcccgccagctcctgcagcccggcctgaccgtcacaatcggcattcagcgccgctttcaggcaacgcagcgccatcggactgttttgcaacatttcgcggcaccagcgcacggtctctttttccagatccgccagcggaacgacggtgttaaccagccccatgtccagcgcctgttgcgcatcgtactggcggcacaggaaccagatttcacgcgctttcttctgaccaacgatacgcgccatatacgaagcgccccagccgccgtcaaaggagccaactttcggaccagtctggccgaagatggcgttttccgccgcgatggtcaggtcacacatcatgtgcagcacatgaccaccgccgatggaatatcccgcgaccatcgcgacaaccggttttggacaggtgcgaatctggcgctggaaatccagcacgttcaggtgatgcacgccggagtcatcctgataaccgccgtaatcgccgcgcaccttctggtcgccgcccgcgcaaaacgctttatcgccttcgccggtcagaataatcacacccacgttgtcgtcgtaacgggcatccgccagcgcctgaatcatctctttgacggtcaacggacgaaatgcattgcgcacctgcggacgattaatggtgatttttgcaataccgtcggtggatttttcataacgaatgtcggtgtaaccctccgagcagtcgtgccattctaccggtgcgtaaagcattgtttcatcaggatagatcatagtgtgtcctttagtcagagacgcagaatctgagccagactgtctaccacgccagcggggttttcccgatgcgcgttgtgtccggcgttacgaatgacatggcatgtcgccgccacttcctgcgccagggcgcggaatttgctgtcgcgttcgccacataaataataaaacggaaatgccagcgcgttgagcgcctcgcgtaaatccggctggacggcaagcgatgtcgcctccagcatcgcagccagcgtttcgccgttattctggctacgcagcgccgttagcgcctgtctttgctgcgccgtcagcgaggcgaacaccggctgctgataccagtcgtgaaaaacctcagtcaatggttcatgacgaaaacgctctgcccagcgcccgtcggacaatcgtctttcagcgcgcgcctgttcattttgcagccccggatgaccgccttcaaccaccaggccgcacaggccgggtattccctggcaggctgccatcatcgccacccggccgccaagagagtatcccaccaaccaaaactttagtatgttgtaactaattaacgtagcgcgcagcaatctgatgacatcggcaaatccgtcgaccggaatagccgcagatccgccatgtcccggtaagtcaatatagagccgcgaacagccgtgaaactgttcgccaaccggctgccattcgtggcaatcgccagaaaaaccgtgcaggaaaaccagcgagggcgtcccaggctgtccgggcatgtgctgcgcgtgcaacatcatagatggcttacctgagccaaaagttgctgcaacgtctgcgcgccgtccgtatcgtttaccaccagctcaatcaccgttgtcgccggggttcgccacgcgccagccagcgcagactccagttcttcccagttttccgggcgatgatagcgcaggttaaacatggcggccgcatggtcaaaatggacgttttgcggcatcaaataaaagcgctcacgtttgctttgcggcgtcggcagcagggagaagatttgcccgccgttattgttgaccacaatcaacacaaacggcgcggatacctgacgtagtaacgccagcgcgttaagatcgtacagcgcggataaatcgccgacgatagccagcgtcgatttagcgctggcgcgctgcacgcccgccgccgtggaaagcaggccgtcaatgccgctcgccccgcgattgctgtataccggatagccagccggcaactgtgacagcgcgtcgatcagacgcaccaccagactattgcccacgaacaattgcccctgctccggcagatagtcgcggatacggtgcgccagctgcgcttcgccaaaggtgtctcgctgcgcgaccacccgttgccacgccagttccgccagacgcgggatctctacacaccacggtttacgtttttccgccggatgcagttccagccaatcggcgattttcgctaccagtctgcgtccacgatggtgcgccgggtccagacgaccttcaatattgtcgattacccagtactcttccggctcgcaggttgcctgccattgcagtaagcgttttccggtaaggctactgccaagctggacgacaatctgcgcctgctgcagttcggtcaccgctttggcgttgccgagccacaggtcggcgcacggcagcggctgcccggtttgcgacaatacgtcgccaattaatggccatcccagagtttgcgcccactgcgccacttttttgccttcttccgcgctcatacgcccggcgacgacaacgccgcgtttttgtcgccagaagaaccagtcgcgctgtttgtcgctttccagtcgacgcgcttcgcgcagccagggtttttcatcctgccaccagtcgccgagacgctgctgccagaccagaccggtatcattcatatcgccatacagcggttcggcaaaaggacagttaatgtgcagcgcgcccgcatgaagcatggcgagcgcattgtcgatggtcgacaccagccagcgcgccggaatatcctgcgtgggacgcggcaacgacaaagtttgggaggggtgcgaggcaaacatccccgcctgacggatcgcctggttggcgccgcagtcaatcagctctggcgggcgatcggcggtaagtaaaatgagcttctcgcccgtcagccccgcctcaatcaacgccggatagaggttcgccacggcggtacctgaagtgacaataacggcaaccggctgttggctgactttcgccagccctaacgccagatgaccaagcccacgctcatcaaagtgcgtatggtgaataaaagcaggattctctgccgccgccaacgtgagcggcgtggaacgggaaccaggggcgatacaaacatgcctgacgccatgacgggttaaggcttccaggatgaccgccgcccagcgccggttaaatgcacttactgacatgagtttgtccggtatcaatcattgggactaagtataaagagctgcaaaaatggattattgatatgggtcgggaatatgtgactcattacgcatccatctgcaataaggtacgtaacccggccgctttattatctatttcctgccattcctgttccggatcggagccgcggacgattcccgcgccggcatacaatcgcaccacattggccgtcactttggctgaacgtaacgtcacgcaaaactcactttgccgcgtggagagatagcctgccgacccggcataccattcacgttcgaacggctcatgttgttctataaaacaacgcgcgggttcacgagggatcccggcgaccgctgcggtaggctgtaactggtgcaggcagagcgtgtcgtccgcctgattaagcgccgtccagatacagcggcgcaaatgctgtaccttgcgcagtctgagcacctgcggcggcagcacatccagcgagtgggtgcagttttgcagtcgctggcagatgtcttcgacaaccagcatattttctcgctggtttttatcgtctttcattaaccattcgccaagctgccaggctttatggttatccggatggttcgccaccgtcccggccagcgcttcggtacgcagcgccgtttcacgccgccgccagagccgctccggcgatgatcccagaaaggcggtatcggcggaaaaggccataaaaaagtggtagcagttgagatttaaacgacgactggacgccatcatcgcggcggcattgaccggacgggagaattgtaagtcggtggcccgcgccagcacaactttatcaaacgcctcttgcgcaatggtgtgggtggcctgctgaatcagcttcacccaaccgtctttgtccggccagtgttgttcgctcgtgagcgaaaggcgtagcgccggaacaggcttaatgccgaccagagaagcgagaaacgctttcgcctggcgcgcatcatcgcgtagcgaaacgtcactgtgcagatgtaagcgtaaggtcgccgtaccaccgctacgtcgccactccagccgcggcagcaataagtagccctctttcggctcgaacgcattcagcccccaaatacgcaggtcaggctgcgcgtgctgacgtaaaaaccgttgcgccagatcgagcgatgaaaatacggtgatggccccgagaacggcagcttcttcgtcgccattgcgctgttgccagtagaattgcggaaaggatgactggctggccagccagctcaatgcatcgaaggcatcgtttaaagggaaaggcgcatcgaaaacgcaaagccctggcgtcgccggtatctcttgcgatagctgacgcgtcagattttccagcgcagtagtaatagaatgcacgcggaccctccctgttaaaaaccccacattatacggggtactgccctaaaaaagcagtacctcatttagggagggttgcaattctgttcagtggggggatttagcgccgcgccagcagcagtccaagcaccagtcctaccgccgcgcctacgccaataccctgccagggtttttcatgaacgtagtcatccgctttataaacggcctgctttgcccggtaataatagctatccgacgcatggcttacgcggtttttcacctcttccagcgcttgttccgcgcgggctttcagctcaatgtatttttgatcggcgggatcgcctgaggaacgtaaaacctcttccagcgtttcgctgagcaaagtcagatcatcatcaacacgtgattcaccaaattgatatgacattctcattctccgttgtgttaacacctgctcctaactatagtcaacggtttcggtttatgcctgatgaacctcccgcgccattccccggtgcggaatgccgtcttcgtcataaacatcggtgacgggaataaaaccaaaccgcgcataaaaaggttgcagatgcgcctgcgcccccagatatagcggcttatccggccagtgccgcccacaagattccagcgttttcgccattaattgctggcccagtttcgcccctcgccaggcatcgctgacgatcacccggccaatgacaaccgggtctgattcgttatcgcttttcagaatcctcgcatacgccaccagttcatcctgatgccagcccagaatatgccgattgtcgccgactaaatcatcgccatccacatccaggtaaggacagcgctgttctaccacaaagaccgcgcagcgcaatttgagtaacgcgtaaagttgaggaacggtaagttcgctatggtggagatcctgccagtcaatcatgatgcgctcctgtgttgtggtaatcttgggttaaacgataaccaaacgtgtatggacaagatggaattaatttttttaggtacgtccgcaggcgttcccacgcgctcacgcaatgtaacggcaattttattacatctgcaacatccaacgcagccgggagtatggctttttgattgcggcgaagggacacagcatcaaatgcttaataccgcgtttcatcccggtaagcttgagcgcatttttatcagccatcttcacggcgatcatttgtttggcctgccgggtctgctatgcagccggtcgatggcggggaacccccatccgctaaccgtatacggacctcaaggcgtgcgtgagtttattgcaaccacactgcgtcttagcggttcatggaccgattttccgttgcaaattgaagaaattagcgcaggtgatattcttgacgacggtctgcgtaaagtgaccgcgttcaggctggagcatccactggagtgctacggatatcgcgttgttgaacatgacaagcctggcgcgctgaatgccagggcgttaaaagccgcaggcgttacgcccggcccgctgtttcaggcgttgaaggcaggaaaaaccgtcacgcttgccgatggaaggcagatcaatggcgccgactaccttgctcccgccgtggccgggaaatcagtggcgattttcggcgataccgcgccctgcgaggccgccctcgcgctggcgcagggtgtggatgtgatggttcatgaaaccacgctggatgcgtcaatggaggagaaagccaacgctcgcggacacagctccacccgtcaaaccgcgacgctggcgcgggaagctgccgttggtcggctaatcatgacccatattagctcacgctatgacgataaaggctgtcagcgcttactggcggaatgccgcgctattttcccggcgacggagctggcttacgatttttctgttttcccggtttagcgctccattttttgtcctcattgccgataacactaaaaaaggcaggctttcataatgaggttaggatggacaattttcagaaagatattgatgacagggccaatttaaccctgtccaaccgttttgaactgctgttattccgtcttggtacatcgctgcatgaacagaagtcagagctgttcggcatcaatgtatttaagctgcgcgaaatcgtaccaatgcccgcctttacgcgcccggcaggcatgaaagcgccgctattgggcatggtcaatattcgggatcaggtcattccggtgattgatttgccagcggtagcgggctgcaagccggaaaccgggctgaatattttgctgatcaccgaatatgcgcgcagcgtacaggcatttgccgtcgagtcggtggaaaatattatgcgtcttgactggcaacaggtgcataccgccgagaaagccgtcaacggtcgctacatcaccagtattgcctgcctggatgacaacaaagaaaccaacaacctggcgctggtgctcgacgttgagcagatcctttatgatattgtcccctccagccacgatctgcgcgccaccaatctgaagaccaataaattttatattaccccaggcgcggtagccattgtggcggaagactccaaagtcgcccgcgcgatgctggaaaaagggctgaacgcgatgggaattccgcatcagatgcatgtgaccggcaaggatgcctgggagagaatccagcaactggcgcaggaagcggaggccgaaggtaagccaattagcgagaaaatcgcgctggtcctgacagatcttgagatgccggagatggatggctttacgttaacgcgtaaaattaaaaccgatgaacggctgaaaaagatcccggtcgttatccactcctcgctttccggcagcgccaatgaagatcatatacgtaaggtgaaggccgacggctacgtggctaagtttgagattaacgaactctcttcggtcattcaggaagtgctggagcgcgcagcaacaaacagccagggaccactgatcagccgcaaaagcgcctgacgtaacaggggatgcctacagtacaggcatcccctgacgcttagtgagacaagccttccgccagttttaccagtttaataaactccgcgcgatagccttgtctatcttccccgcgcgcctgttcaccccatttaataatttgcggccaggtcgtatctgccagcgtttctgagccacgcagtttttgcccgaaagccgctaccgccgcgcggaaacgaaaatcttcagaggcgtcagcaaagatcggcatctttcccataacgaccgggaactcggctaatgtactttcgctgccctgcggcgctttccagcgcaatttgagccacgccagctcgcttgattttgttgtctttgaggcggctttgttctgagcgtagcgcagtttatccaccgaggctttctgcccgttaagcgtcagttcaaagaatagcgtgacgtgtttacccgcgccgatatcaccggcatcaaccttatcgttattgaaatcctcgtcgcgcagttggcgtttttcataaccaatctgccggtactcagtcacccactgcggattaaattcgatttgcgattttacatctttggcaacggtgaccagcgtttgatgcatctcatccttgaggactttttgcgcctcagagagggagtcgatgtagctgtaattgccgttacccacatcagcaattctcaccatcatggcttcgttgaaattgtcatcgccgacgcccagcgtagataaggtaatacctttctcgcgctctttttttaccagcgcttcgatgtctttgggatcggtaataccgaggttaaaatcaccgtcggtggtcaacaaaatgcggttaacgccgcctttgataaaccctttttcggcctgctcgtaggctagtcgtaatcccgcttcaccaccggtactcccgtaagcatccagattatcaattgccgctttaatcgcggttgtgttatttcccgctgtagacgccagcgcgacgtgagtgccgcccgcgtaggtcacaatcgtgatgttatcctgcgcacgcagatcgttcaccaacagttttagcgccgaccggatcaacggcaggcgttccgctggctgcatagagccggaagtatcaatgagaaaaaccaggttggcaggtggtagatctctggtctgcatgtcccgggcctgaacatcaacttttaatagcgtacgctgcgcgttccacggcgagggagccagttcgtatttaaccgcaaatggcatcggtatacaggccgcaatgggtttagtgttatcctgcttatccgcaacgggctgaggggcgggaaagtagttgagcatctcttctacccgcacggcttccggcggcggcagttgtccctgattcagaaagcgccgcacgttagcgtagctgccagtgtctacatccagactaaacgtggcgagcggcgcctgacttacctgtttaatcggattttcatcgtagtgttcgtaacgcgcggtccccattacattaccgccttgtgcagcgaacgcttttggtgccgcggcacgtgtctgcattacatattgcggtgcttcggctgttgccagagatgccgctttggcatctgccagggctttggcttcagcatattcggctgcttttttcgcagcctgttgggcggcctcggcttgtcttttctggacagtgtcatccccggcctgagcgctattttctttctggatagtccgcttctgttttaactcagccggattatttccctgcgggtcggagggctccggcccacagcccgagagaataaccccacccaacaacagcattaatgtttttccgttaagcatacaaattccttttcaattatattcgggtaattctctgcagatgtcctgcattatattccgcgttacttttattatcagcatgacgaaagtagaaaataattttacctgcgttaatagccaccaataataaaaaagataattatatttttgaggtaaataatatttacgtttaagatgaacggcttaatcagttgctggcgttcgacccacagattctgcgtgaagaacactatttacaggtgaccgatttaccaaaagtgaatatataagatgggggactatctgcactgtgccctcgccgatacttccttttacaacccaccaaacagcaatccattaagccgtgccgacactcacgttattgatggaaagatattatatgctgccgtcacatgaaataatgaactgagcgcgatcggacgccttgaaaaacgctgacagaaatacgcttcagatcaaatttttcccattgaagtcgatgagataaacatttatccgggaaacgggtcacgaaaacagttgggagagttgttccactgcctgatgcaagaaatggacaaactgctgagtttttatcagcgatgcctgagaaatgacagtcacgttataatttttatagcggagtaatgggccatatgtttaacacttcgacaattattgtgaattacccatatgaaaccgctggcgcttacggaaccgcccaacatccggctcttcgttcgtcgggacgtgttgggtttcggctacgcctcacccaacgagtctatggtctctatgcgtcacaggttttcataagttggatgcaatccaacatttagaggctcaggtattgctcatcagcctcaaccgccgataaatcggcggttattgacatcatcaacgcggcattacatcagcggcatcgccagttgcacaaggctaatcagcggctgcggccagacgcccagtaccaacaccagcaacgcggagatcagcaccacgataccgcctgcgctgtactgccagtttgtcggcgcgtcgcgtcccggttgctgcggcgcgtgcaggtagagactcaccgcaacacgcaggtagtagtacaaaccaatcgcggaacccactaccacggcggcgaccagccaccacaggctggcctgaacgccgaccgccagcacgtagaatttgccgataaagcccagcgtcatcgggatacctgccagcgacagcatcatcaccgtcatcaccgcggcaagaaccgggcggtgccagaatagaccacggtaagagtacagagaatccgcatccgggccgcggaacgggctggacatcaggctgaccacgccaaacgcgccgaggctgctgaacagataaccggccagataaacgcctaccgcttccatcgacatctcgccgctctgcagggcaatcagcgccaccagcagatagccgaggtgagagatagaagagtaaccgagcagacgtttgatgttggtctggctcagcgccatcaggttaccgaagatgatagaggcaaaggcgataatgcccagcaccacgcgtaccgcttcgctgtcgcctaccggcgcatacaggaacagacgcatcaccacgccgaagatagcgattttgctcgccgtcgccaggaaggtagaaaccggcgcaggcgcgccctggtaaacgtctggcgtccacaggtggaacggcaccagagagagtttaaagcccagaccgacaatcatcaggccaaagcccgccagcagcaacggctcgtgcagcataccatcgccgaggctcttaccgagcgcttcgaaagacaggttgccggactgcgcatagaccagcgccatcccgaacagcaggaaagacgaggcggcggcggagaggatggtgtatttgatactggcttccagcgagcgtttctggcggaaagcataaccaatcaggccgaacagcggcagtgagatcagttcaataccgaggaacagcgccgccagatggttggcgttcgccagcagaattccgcccaggctggcgattaacaccagcaggtagaactcttcctggttatcgttatagccttccagccacgggtaggcaaaggtacaggtggcgaggctcgccagcagcaccagtccggtgtagagcatcgcaaagccgtcaacgcgcatcagcggcgtgacgtccattgccccggcctggccgacaaaccaaagcgaaaccagagcagcgttaagcccaatgaccgacagcgtggcattgaggaagtgattgcgtcgccacgcaatggagagcatcacaaccaccaccgtcaagccgacgatcagcagcggtagcagcgcaatcaggtgttgtggagttattgtcatggcgatttacggccttgtagtagtaacggaattaacaaaccactgctggatgttgctcatcgcagaatgcgaggtatccagaatcggctgcggatagaagccaagcagtaccagaagcaccaccagcaacagaatgataaacagctcgcgcagcgacatccctggcagttctacactggcaatctggctcttcgccttaccaaagtaagcgcgatgcagcatcgccagcgagtatacagaggcgaataccagcccaaaggtggagatcacggtaatcaccggcaccacctggtagctgccgaacagaatcataaattcgccgacaaagttaccggtgcccggcatcccgagcgtcgccaccgcaaagaacatggacagcgcaggcaaccatttcattttgccccacaggccgcccatcatacgcatgtcacgcgtatgcagacgttcgtacaactggccacacagaatgaacagacccgccgcggacaaaccgtgcgcaatcatctgaatcaccgcgccctggtacgccagctgactgccggtgtagatagcgatcagcacgaagcccatgtgggaaacggaggtataggcaatcaggcgcttgatgtcgtattgggtaaaggccatccacgcgccgtagaaaatgccgataacgccaagccacatagcgataggcgcaaactccgccgacgcgttcgggaacaatggcagggagaaacgcagcagaccgtaagcggcggttttcagcaagatccccgccaggtcgacggaaccggcggtcggcgcctgggagtgcgcatccggcagccagccatgcagcggaaccaccggcattttcaccgcgaaggcgatgaagaagcccagcatcagcagatattccacaccgtgggacatcggcgtattcagcagctcttcataattgaaggtccacacgccggtcgcgttgtagtgcacaaagaccagcgccaggatggcaatcaacatcaccagaccactcgcctgggtgtagatgaagaacttggtcgccgccgtgatacgcgttttcccgtcagaagctttgtggccccacagcgcgatcaggaagtacatcggcaccagcatcatttcccagaagaagaaaaacaggaacatgtcgatggccaggaacacgccgataacgccgcctaagatccacatcaggttcaggtggaagaagccctgatatttttcgatttctcgccaggagcaaagcaccgccagaacgccgagcaggccggtcagcaccaccattagcagcgacagtccgtcgagcgccagatggatagagatgccaaaacgcgggatccacggcaggacaaattcagattgccactgcggaataccggcggattgcgtcagtgaatagccgccctgcaaccacaattgcagaccgagcgccagcgtcagccccatggtaatcagcgctatccagcgcggcaccttcacgccaaagcgttcggtctgccagcacagaaagccgccgataaaggggattaatatcaaccagggtaataacatagctaagtatgtcccttatatttactcctgctcaggctatctcactcgtcagcccaaatcctgccagtgctcacacaaaacgcagcgcgttttgaacgtccgtaaggacggccccgtaggggtgagcttcgcgaatcatcctcacgtacttcagtacgctccggttgctgtgcgctggcggtatccggtctgacttcgccgatgacgcctgtacttcaggaacagattttcaacgaattctaaaaattatttttgggtttgtaggccggataagcactgcgccatccggcagtcgttcatccagccaacaaactcaacgcagtaccatcaacagtgccagcacaacgacagcgccgatgctcatggatgccacataccagcgcaaataaccgttctcgctcagtaccaggcctttgcctgcaaaacgggaaaggatagccggaatgttcatcaacgcattaagcgggtcgcgcttcagcagccaggcgataccgaggaatggcttgacgaatactttgtcgtacagccagtcaaagccccaggcgttataccaccaggtgcccagcagacggcccggcgcgctgttggcgatcgacgtcaccagcgtacgtttacccagccacagccatgcggcaatcagaatgccggcaatcgccactacgccagaggtaatttccagcgtcatgacgcgaccatgcgccagttcagttgtctgcggcagcaccccctgcagcggcggcacaatcagcgcgccaacaaaggtagacagaatcatcaggacaatcagcggcagatggtgggtaatccccttccctgcatgagcatgaatttgttctttaccgtggaatacgatgaaaatcatccggaaggtgtacagggaggtcatgaacgcgccgaccagacccgccaccatcagattgatatgaccgttcgccatcgccccggccagaatctcatccttactgaagaagcccgcagtgaccagcggcagcgccgacagcgccgcgccccccaccaggaagcaggcatacaccagcggaatggacttacgcagaccgcccatcttaaagatgttctgttcgtgatggcaggccagaatgacggaaccggacgccaggaacagcagcgctttgaagaacgcatgggtcatcagatggaaaatcgccgcatcccacgcctgtacgccaagcgccaggaacatgtagccaatctggctcatggtggaataggccagcacgcgtttgatgtcggtctgcaccagcgcggcgaaacctgccattaccagcgtaatcgccccgataatgcccaccagatgcagaatttccggggtcatcaggaacagaccatgggtacgagcgatcaggtagacaccggcggtcaccatggtggcggcgtggatcagcgcggagaccggcgtcggaccggccatcgcgtcggcaagccaggtctgcaacggtagctgcgcagatttaccgaccgcgccgcccagcagcatcagcgtcgcccacatcagcatgttgttgccgtcagcaaagtgcgctggcgccagctcgaccatttcgcggaagttcagcgtgcccagttcgttgtagaggatgaacagcgcgaaggcgaggaatacgtcaccgacacgggtcaccacgaaggctttcattgccgccgcgccattcttcggatcgctgtaatagaagccgatcaacagataagagcacaggcccacgccttcccagccgaggtacatcaacagcaggttatcggacagcaccagaaccaccatgctggcgataaacaggttggtataagcgaagaagcgggagtagccctcttctccacgcatgtaccaggacgcaaacatgtggatcaggaagccgacgccggtgaccacagagagcatggtcagcgacaggccgtccagcaccaggttaaaaccgatgttaaagttaccgaccgacatccacgtccacagcggctggctgaacgcctgtttgccgttggcgaagaaatccatcccgacaaacgctgtcaccaacgccgccagaccaacggagcccacgccaatggtcgcggagagattttccgaccagcgtccgcgagagaacgccagcagtacaaagccaatcaatggcagaataatggttaaggcaagcatgttcatccacgcatctcacttactgaatcgatgttcaggttctggcgacggcgatggagttgcagcaacagcgcaagtccaatactcgcttccgcagccgcaaggctgatggcgagaatgtacatcacctgaccatcggtctggccccagtagctcccggcgaccacaaaggccagcgcggaggcgttaatcatgatttccagcccaatcagcataaacagcagattgcggcggataaccagaccggttaaacccaggacgaataaaatcgcagcgaggatcagtccgtgtgttaaggggatcatgcgcgctcctccgtttttcttttcgcgcggtcatcggcgcggttgcttagcacttcgcccgcacgctcttcacgaccgacgtggaacgccaccaccaggcctgccagcagcagcatagacgccagttcgaccgccagaacataaggcccgaacagcgtaatgcccaccgctttcgcgctaatcggcgtgccgtcgatgccctggtcgttaacgcccagaatggcgtacacaatgaccgccagcataatggccgacaaaaccgccggaccaatccacacctgcggcttcagccactggcgttcctgttcgatttcgctgccgccgaggttgagcatcatcaccacgaacacaaacagcaccatgatggcgcctgcgtagacgataatttccagcgcaccggcaaagtaagcgcccagcgaaaagaacaccccggaaatcgccagtagcgatatcaccagatacaacagcgcgtgtaccggattggtatgggtgatcactcgcagggtcgcgaggatggctatcaggccacagatataaaaagcgaattccattgccctctccttacggtaacaggctcttgacgtcgataggcttggcttcgttctctgcttcgcctttatctttgccgtcgattgccatacccgccatccggtagaagttatattccgggtatttgcccggaccggaaatcagcagatcctctttttcgtacaccagatcctgacgtttgtattcgcccagttcgaagtccggggtcaactgaatcgccgtggtcgggcacgcttcttcgcacaggccgcagaagatgcagcgtgagaagttaatgcggaaaaattccggataccagcggccatctttggtctccgctttttgcagagagatacagcctaccggacaggctaccgcgcacaggttacaggcaacgcagcgctcttcaccgtccgggtcgcgcgtgagcacgatacgaccacggtaacggggcggtaaatagaccggctcttccggatacatccgcgtttcgcgtttggcgaacgcatgcaggccgatcatccagatactgcgtacctgagtgccgaaacctactaataattcttttaaggtcatggtctttgtgtcccttattgcgcctgccacagaatgacagccgccgttaccagcaagttgatgagcgtcagcggcaggcaaactttccagccgaaggacattacctggtcataacgcggacgcggtaacgacgcacgaatcaaaatgaacatcatcatgaagaacgcggttttcagcgcgaaccagacgaatggcggtaagaacgggccatgccagccaccgaagaacagcgttaccatcagcgcggaaacggtgacgatgccgatgtactcccccacgaagaacagaccgaatttcatcccggaatattcgatgtggtaaccgtccgccagttcctgttcggcttccggctggtcaaacgggtgacggtgacagaccgctacgcccgcgatggcgaaagtaacaaacccaaagaattgcggaatcacgttccacagatgcgcctggttattgacgatatcggtcatattaaatgaaccggcctgcgccaccacgcccatcagggaaagaccaagaaacacttcgtagctcaccgtctgggcagacgcgcgcatcgcgcccagcagcgagtatttgttgttgctcgaccaaccggcgaacagcaccgcgtaaaccgccagaccggccatcatcaggaagaacaaaatcccgatgtttaaatcggccaccacccaattagggctaaccggcacaatggcgaaggagagcagcagcgaagtaaacgcgatcatcggcgccagggtaaagatgacgcgatccgagaatttcgggatccagtcttctttaaagaacatcttgatcatatccgcgaccagctggagcgagccgccccagccaacgcggtttggtccataacggttctggaacagacccagcagacgacgttcgccaaagctcatgaaggccccgcaggtgacgaccaccagcagaatcaccaccgctttgagaatgctcagcaggatctcaatcagatccggtgtaatccaactcattgttgcgcctcccgcagatcctcaagacgcgcgccagccagaaccggcgcgatgccaggcatacccatcggcagccctacctgccctgccgctaacccttcagagatttcaaccggcagcgtcaccgtattgccatcgtagctaaaggagacgcgcgtcccggcattgacgcccaacttcgcggcatccgccgggttaagtttgatatacggctgcggcatacggctctggaagaccggagaacgctgagacaattcgtcgctgccaaacaggtggtaatacggcgcaatacgccactgaccgtcctgcgcctggaagcttgccggcacggtagtgaaataatccagaccgccctcagtcgcttcaatcaaacgcacgcccggatcgccgtgacgcagtttgccgcccacttcatcctggaatttgttccacgcctgcggggagttccagcccggcgcccaggcgaacggaatttcagatcgcggggcagtcggttggttattcccttccattgagaaggcgaacatggtgtctttatcctgcggctgacgtggttcatgcacgctgatattggcgcgcatcgccgtacgaccgctgtaacgatgcggttcgcgcgccagcttctgcccacgaatgcggaaggtcgcatccggcgcggcgtccttaatgccggcaaattgcggcatggcggcaatgaccgcgtcgatcacgtggtcaagctgagtccagtccacttcgcggttttcgacggtgctgtgcagtgaatgcagccagcgccagctttccagcataatcgtcttgttatcgtagtaggccggatcataaacctggaagaagcgctgcgcgcggccttcgttgttgatgaccgtaccatcgctttcggcgaagcttgccgcggaaagcaccagatgcgcgttttccataatcgccgtgcgctgatggtcaaccaccatcaccagcggcgctttggcgagcgcagcgttcacgcgcgtagcgcttgcatgacggtggagatcgttttccagcaccaccacggcgtccgcgctgccggtttccagctcgcccaacgcatcatcaagcgaaccgccgcccatcatacccagccccatgctgttcacggagcgggcaatcatagtaataccgacgtcggcgccacggcctttcagcgctttcgccacgttggcggccgcctgaatcacctcactgctaccggcgttagtgccggagataatcagcggttttttcgcgccggccaacgcctgcacaatgacatcaattttgttttgtaagtcgctgtcgataccgtcaaccgcaggcgctgtattgtccagcgcatgagcaatcgcaaagcccaggcgcgcctgatcttccaccggcgcgcgataggtccaggcggcgatatcatccagacgggtgtcatccacgttggtcacgaacagcggatgtttggcacgctggccgatgttaaggatggccgcaatctgccagtcggccactttctgcgccgccgccatttcacgcgctttacctttcaccgcctggcgtaccgccagcgcaacgcgcgcgccggtctgagtgacatcctcacccaagaccagtaccgcgtcataagattcgatctcccgcagcgccggggtgtaaattccgccttcacgcagcactttcagcgccagttgcagacgttcctgctcgccgcgcgcgataccggtgtagaagttttccgcaccaaccagctcacgcagcgcaaagttgctctcaatgctggcgcgtggcgaaccgataccgatcactttcttcgactggcgcagaatatccgccgcgccctgcatcgcctgctcggcgttgagggtgatgaagtcatcgccacggcgctgaaccggctgacgcggacggtctttcaggttcacatagccatagccgaaacgaccgcggtcgcagaggaagtagtggttaacggtaccgttgtaacggttttcgatacggcgtaattcgccatagcgctcgcccgggctgatgttacagccgatggaacactgctgacagatgctcggcgcaaactgcatgtcccatttacggttgtaacgctcggagtgcgttttatcggtgaagacgccggtcgggcaaatctcgaccaggttaccggagaattcgctttccagcgtaccgtcttccggacgcccgaagtagacgttgtcatgcgcgccatagacgcccagatcggtgccgtcggcataatctttgtagtaacgcacacaacggtagcaggcgatgcagcggttcatttcgtgcgagatgaacggccccagatcctggttgcggtgggtacgtttggtgaaacggtagcgacggaaactgtgccccgtcatcacggtcatatcctgaagatggcagttaccgccctcttcacagaccggacagtcgtgcgggtggttagtcatcagccactccaccacgctttcacggaactgtttcgcttcttcgtcgtcaatagagataaaggtaccgtcggtggctggcgtcatacaggacatcaccaggcgaccacgcgtatcttccgcgttttggtattgcttcaccgcacactggcggcaagcaccgacgcttcccagcgccgggtgccagcaaaaatacggaatatcaaggccgagggacagacatgcctgtagcaggttgtccgcgccattgacctcgtattctttgccgtctacatgaatcgtagccattagcatgcttccaaattaaaaatcgttaactcaccagcgctctttgagcaggttcggctgaataccattgattaaatgggtattactgaacggctgcttgatgccagcttcgaattcttcgcggaaatacttaattgcgctttgcagtggctcaaccgcgcccggcgcatgcgcgcagaaggttttacccggtccgaggaaacgacacagttgctcaagtgtctcgatatcccccggctggccttcgccacgctccagcgcgcgcagaattttcacgctccacggcagcccgtcgcggcatggcgtacaccagccgcaggattcgcgggcaaagaactcttccaggttacgcaccagcgacaccatgccgatttcgtggtctaccgccatcgccagcgcggtgcccagacggctgcctgctttaccgatgctttcgaactccatcggcaggtcaagatgcgcctcggtcaggaagtcggttcccgccccgcccggctgccaggctttgaatttcaggccatcgcgcataccgccggcgtagtcttcgaggatctcgcgcgcggtggtgccgaacggtaattcccacaggcccggattcttcacgcggcccgagaagcccatcagcttggtacccgcatctttgcttttcgagatgttctggtaccactccacgccgttggcgaggattgccgggacgttacacaacgtttcgacgttattcacacaggtcggcttgccccatacgccggaggtcgccgggaaaggcggcttggagcgcgggttcgcgcggcggccttcgagggagttaatcagcgccgtttcttcaccacagatgtaacgccctgccccggtgtggacaaacagttcaaagtcgaacccggtgcccatgatatttttgccaagcagcccggcctcggttgcttcggcaatcgcacggcgcagatgtacagccgcttcgatatattcgccgcgcaggaagatgtaaccacgatacgctttcagcgcgaacgcggagatcaacataccttccaccagcaggtgcggcagttgttccatcagcagacggtctttataggtgcccggttccatttcatcggcgttacacagcaggtaacggatgttcatggattcatctttcggcatcaggctccacttcagaccggtggaaaagcccgcgccgccgcgccctttcagaccggcgtcttttacctggctgacgatttcatccggagacaggccggtcagcgccttacgcgcgccttcgtagccgtttttgctacgatattcatccagccagaccggctgtttgtcatcgcgcagacgccaggtcagcggatgggtttcgggagtacggataacgtttttcatttataccgctccagtagttcaggaatggcttccggggtcagatggctgtgagtatcctcatcaatcatcatgttcggccctttatcgcaattccccaggcagcaggtcggcagcagcgtaaagcgaccatcaaaggtcgtctgccccggtttgatgttgagatttttttccagcgcggcctgaatcccctgatagccggtgatatggcacaccacgctgtcgcagtagcgaatcacgtggcgaccgaccggctgacggaagatctggctgtagaatgtggcgacgccttcgacgtcgctcgccggaatacccagcacatcggcaatagcgtagatcgcgccgtccggcacccagccacgctgcttctgaacaattttcagcgcttcaatggacgccgcacgcgggtcttcgtagtggtgcttctcgtgctctatcgcttcacgctctgccgcactcagctcaaaagcctcggtttgtggttgttgattctcgtgcataattagcggtccacatctgacataacaaaatcgatactacccagatagacaatcaggtcggagaccaggctaccgcggatcgccgagggaatctgctgcaagtgcgcaaagctcggcgtgcgcacgcgggtacggtagctcatagtgctgccgtcgctggtcaggtagtaactgttaatccccttcgtcgcttccaccatctggaaggactcctgcgccggcatcaccgggccccaggagacctgcaggaagtgggtgatcagggtttcgatatgttgcagcgtgcgctctttcggcggcggcgtggtcagcgggtgatccgctttgaacgggccttccggcatgttatcgaggcactgctgaagaatgcgcagactctggcgcagctcttccactttcagcatcacgcgggtatagcagtcggaaacgccgccacccaccggcacttcaaagtcaaagttttcgtagccagagtatggacgccatttacgtacgtcgaagtcgatcccggtcgcgcgcagccctgcgccggtggtgccccactccagcgcctctttcgcgccgtaagcggcaacgccctgcgaacgccctttcagaatagtgttacgcagcgcggctttctcgtaagaatccagacgcttcggcatccactcaaggaactctcgcagcaggcgatcccaaccgcgcggcaagtcgtgcgcgacgccgccgatacggaaccaggccgggtgcatacggaaaccggtaatggcttccaccaggtcataaattttctgccggtcggtaaaggcaaagaagaccggcgtcatcgcgccgacgtcctgaataaaggtcgagatgtacagcagatgactgttaatgcggaacagttcggagagcatcacgcggatgacgttcacacgatccgggacggtgatccctgccaacttttctaccgccagcacgtacggcatttcattgacgcaaccaccgaggtattcgatacggtcggtatagggaatgtagctatgccaggactggcgctcgcccattttttcggcgccgcggtggtgatagccgatatccggcacgcagtcgacgatttcttcaccgtcaagttgcaggataatacgaaacgcaccgtgcgcagacgggtggttcgggccgaggttgaggaacataaagtcctcgttgtcagtcccgcgcttcatcccccagtcttccggcttaaaggtcagcgcttccatttccagatcctgcttggctttggtcagctcaaacgggtcgaattcggtcgcgcgcgccggataatctttacgcagcggatggccttcccaggtttgcggcatcatgatgcgcgtcaggtgcgggtggccttcgatatcaataccaaacatctcccaggtctcacgctcgtaccagttggcgttagggaaaagtttagtgaaggtcggcacgcgcaggtcgttttcagacaacgccaccttgagcatgatatcgcgattacgctcaatggaaatcaggtggtagaaaacggaaaaatccgcggcgggtaacccgtcacggtgcgtacgcaggcgttcatccatgccgtgtaagtcaaacagcatgacgtaaggtttcggcagtttctttaagaaatcgccaacctccagtagttgttcacgcttgacccaaacaacggggataccggtgcgggtcgcctgaacggtaaaggcatccggcccaaaacggttgcgcagttcgccgataaccggatcatcaagatgatcgcgggtactccatgcagcgtcttgcgcggttaagtcggtcatattgttcaccattgcaaatggtccgtggtggtcggcagtgcttcgcgctattaaaatagtggttagcgaagtgaagtgctgctgccgacaggcgcaaattaaatctcgtccggggtacgcaggttcgtgacggcaatacgctcgccgcgtttacgttcgcgttctggctgcatattggcgcgatacacgccctgatcgcccaccacccatgagagcggacggcgctctttgccaatcgattcttgcagcagcatcaacgcctgcatatacgcttccggacgcggcggacagccagggatatacacatccaccgggatgaacttatcaacgccctgcactaccgaataaatatcgtacatgccgccggagttggcgcaggcgcccatagaaatgacccattttggctccagcatttggtcatacagacgctgaataaccggggccattttggtaaagcaggtaccggccaccaccatcaggtcagcctgacgtggcgacgcacgcagcacttccgcgccgaaacgggcaacgtcatgcactgcggtaaaagaggtcaccatctctacatagcagcaagaaaggccgaagttgtagggccaaattgagtttttacggccccagttaaccatgtcatgcagtttgcccatgaacacgtttttgttaacttcctgctccagggggtcggttacgatctcctgtttttgcagggggtaacggtcattctcaccgttaggatctatgcgggtgagcgtataatccatcttaatgcctcgcggttagcgttgacgattagcgatactgttcgtttccgggttcatacgctcgcggcgtgaacgcgcgggcgtccagtccaacgcgccaatacgcgccagataaaccagaccagccagtaacacaaaaataaaaattgcagcttccacaaagccaacccagccgctttcgcggatagaagtcgaccatgcgaacagatacagcgcttcaacgtcgaagataacgaagaacatggctaccaggtaaaacttggcagacaggcgtaagcgggcggtgccgaccgaatcgatacctgattcaaacggaacgttcttgtgcctcgcgcgtgcgcgaccgcccaaaaaccaaccgcctaccagcatcaggcagcacaggccaatggcaacgataagaaagatagcgaatgcccagtgatgagcgatgacttcagtggatgttgacatactcattgcttactcatcaaaagtagcgccagtttctctgctctttacggcagatgggcgccacatcgattcatggggaggaataaaaaaaaccctacaattactgtagaaaatgataaaaacagctaattgatgtggttttttactcctttctataaccttttgtcaactttaacaaaagttccttcacattaatttacatcaattcatcaccattaacattaagtgccatcctggagaaaatgactcttcgaccaggggggattttatgttgttgaatcgtgtccgttgtgaagcaaaagaaataacacacacctattttgacaggaatttgtgaagatgcctccccctaaatgggagtattttcttgatctgtgacacgcttttgttaattcaccccctaaaacagcaacaatttctctagttttttaacatgcaaattcataaaatggatgttctggttattttttgcccacattgaactgcgaatcgctactggctgatttaccgcaacttttacaatttgtgcggttaagcgcgtacagatgggcacaaaaaaagagccactgagcgttttttcatcgccagcggctcttttttacatttacgacttagcgccttttgcctgcgagctactcaaaacccccttccaccatcagcggatcatctccgccctctgcagaaaactggttgtaatgccatgggttttggtagctttccatcgcatggaaaatcaccatcgccagctcgttctggctattgggatcgcggcacaacagatattccgtatccggcaaaggcggtaatccgtctgcggcgcccagcacgcgaaggtcgggactcatcatttcgacaggtcgagccgttacgccaagaccggctttaacggccgcgcgtaccgccggtaatgtagacgccacataggccagccgccagggaatacccgctgcatttagcgtctccagcaccatatcgcggaatgggctgggatcgtccagcaggactagtggtacgggctctcccctttgcaaaacatactcagccgcacaataccaatgggtgggcgaggtccgcaaattcagacagtccagcgaatgaggttggttagtcgtcaccaccaaatctacttcctgcgatttaaccatgtccaccatataggcgttgcgttttacccgtacatcaagcgcgagtttcggataaaccgagctgattcggctaagcaaaaaaggcaggatagtatcagctgattcatcagaagcgccgattgttaacactccctgaagattactgaacattaatgatgaacacgcctcatcattaaaacgcaggatttttctggcgtaccccagaagctggataccgtgttcggtcaaaagtttgttacggccatggcgggcgaacaattcctttcccacgagttgctcaagacgctgcatttgctgactgaccgcagactgagtacgacataccgccgccgccgccgcggcgaaggtgttcagatcggcaacggccacgaacgttctcagcagatcgagatcgaggttaattatcggacgatttgcatttatcataatttttcacttactggcgggtcatatcgggctgacctggttaatgctgtgcattcagaaacaagcaattccatttgtaatgtgcatccttcgcagtaccgcctggttacccaggtaaatgttagaatgtaattgaaaatacgaccaaaacacttctcttacttactgatataataccaaatgcaactgatcgggatatatcaaagagaatttgtcatacctttaggcgtctacagatttctgctaatgatggacgtgtaaatcttgtaacagcgtcaaatagtttaccgagacgcacagatacaaaaacaatatattgaacaataggttatgtataaaatcgcgtcatgataattagcagacaacgcagactacgcccccgtttcggatcattatcttaacctaaaaccgctatatttataagtattattacgaataatcttaacctgggatatgttatactaatcggaccagaaagatattattacgactttagtaaatgctttttaaatattaaataataattaattaagatttctaccattcattaattatacttaacaatagtttcacaccccccgccgccggaaaggtctaaccttctcattttacctttaatactcagtatttccgaaatagccgacgcgacactaatgatgaatgcttatctctcataaaacagataatttatgacaacataaaaaaccacattacgcgcaatcatatagaacaaaacaccatacatacagaaaaaaatagaaaatacatctaactaaatgattttatgaagttttaaacagttcgaaagcgcgttaaaaataaacaaaatcttcttctgttcactcttcaaaactcaccgtcgtgggagtacattgtttcgtgctgacttccacggcagggagtggcaataacagctaaaaggtcaagattcatgtcccccattgaaaaatccagcaaactcgaaaatgtctgttatgacattcgtggccccgttctgaaagaagcgaaacgccttgaggaagaaggtaataaagttcttaaactgaatatcggcaaccccgcccccttcggattcgaagcgccggacgaaattctggtcgatgtcattcgtaatttgccgacggcgcaaggatattgcgactcgaaagggctttattccgcccgtaaagcgattatgcagcattatcaggcccgtggaatgcgcgatgtaaccgtggaagatatctatatcggtaacggcgtttccgagctgatcgttcaggcgatgcaggcgttgcttaacagtggcgatgaaatgctggttcccgcgcccgattatccgttatggacagcggcggtatcgctctccagcggcaaggcggtacattatctttgcgatgaatcttccgactggttcccggaccttgacgatatccgcgccaaaatcaccccacgtacgcgtggtattgtcattattaatccaaacaaccctactggcgccgtctattctaaagaattgttgatggaaattgtcaacattgcgcgcgagcataatctcatcatcttcgccgatgaaatttatgacaagattctctatgacgatgccgagcatcactctatcgccgcactggcgcctgatctgctgaccatcacctttaatgggttgtctaaaacctatcgcgtcgccggcttccgccagggctggatggtgctgaacgggccgaaaaaacatgcgaaaggctatattgaagggctggagatgttagcctcaatgcgcctgtgcgccaacgtcccggcgcaacatgctattcagaccgcgctcggcggctatcaaagcattagtgaatttattctgccgggcggtcgactgtatgaacagcgtaaccgcgcctgggagttgattaacgatattcccggcgtttcctgcgtaaaaccgcgcggcgcgttgtacatgttccccaggatcgacgctaaacgttttaatattcacgacgaccagaagatggtgctggacttcctgctacaggaaaaggtgctgctggtgcaaggtaccgcctttaactggccgtggccagatcacttccgcattgtgacgctaccgcgtgaagatgacctggagatggccatcaaccgttttgggcgtttcctctcaggttaccatcaataatcttaaattcaggctacttcggtagcctgaattgcatcttcatctccctccccgcacaatgaagtctgccgcagtgaaaacaaaaggtaatctatgaagcagagccattttttcgcccatctctcccgcatgaagttgattaaccgctggccgctgatgcgtaacgtgcgtacagaaaacgtctccgaacatagtctgcaggtggcgatggtcgcccatgcgttggcggcgataaaaaaccgtaaatttggcggtcagctcaatgctgaacgcatcgcgcttctggcgatgtatcatgatgcctcggaagtactgaccggcgatctgccgacgccggtaaaatattttaattcccagatagcccaggaatataaagcgatcgaaaaaatcgcccagcaaaagctggttgatatggcgccggatgaattacgcgatattttcgcaccgcttattgatgagaatgcctggagcgaagaagaacaggcaatcgtaaaacaggccgatgcgctttgcgcctacctgaaatgcctggaggagctctcagcgggaaacaatgagtttggactggcaaaaacgcggctggaaaaaacgctggaattacgtcgcagccaggagatggactattttatggcggtattcgtaccaagtttccatctttctcttgacgagataagccaggattcaccgctttagttgccggatggcggctaacgccttatccggcctaccgttcttcccgtaggcctgataagcgtagcgccatcaggccttttcctgtctggggttaaaacggaaacaacattggaatcatcacaatacaaaccgccatcacaataagcgtgaacggcacgccaagcttcacaaaatcgctaaagctatagtttcccggccccagaaccagagtattgaccggcgatgaaaccggcgtcataaaggcggcggatgccgccatcgccaccgccatcgcaaacggatagggcgacacccccatcgatttcgccgccgccagcgcaatcggcgccatcagcaccgccgttgccgtgttagaaatgaacagtcctatgacggcacacagcacgaacaggcatcccagcatcatatacggcccatagccgccgccgatatccattaatccttgcacgaccagagagacgccgccggttttttgcaacgccagcgcaaacggcatcatacccacaatcaagataatactcggccagtggatcgctttatacgcgctttcagcatcaatacagcgaaatttccccatcagcaggcaggcgataatcgccgcgatcgggttgggaatttcatcggtcaacatcagcgccaccatcagtaccaggcagaaaatggcgtgcggcgcctggctgtgcgcaggagaggcttcgctgacctcgaccggcatattcagcaccacaaagtcgcggcctttttgccccagcaggctgattaacttccagttccccacaaccagaatgatatcgcccatcaataacggttcatcggccagcgatccttccagcgcgacgccgtcgcgtttcaggccgaccacattcagcccgtaacgtgtacggaaggcgatttcacgcaccgacttgcctatcagttcagactccggaataagcgaaatttccgccatgccaacatccaacgcctgatcggaaaaatattctccacgcaataccatcggttccagcagttgctcggcgcagaactctctgaggtcaacctccgccgccgacatatcaatcagcagaacgtcgcgagcgcgaaactccgatacgccgttcacattgacgataacccgccgaaagcgccgccagcgttcaacgccgatgacattggcgccgtaacgttcgcgcagtttaaggtcgtccagccgctgtcccaccatcggcgaaccggggcgaatcgccagacgacgagcgcgccccgtcagacggtactcgcggataagatcgcggaaagtgcgacgcttaccggcctgttgtccgggcgcatcgccttttagcatgaagcgcatcaccagcatataaacaatgccgagcgccaacaccactacccccagcggcgtcacgctaaaaaagttgaacccgtgcaggccttcacgcagcagttcactgttaaccaccaggttcggcggcgtcgccaccagcgtcatcattccgctgataagcccggcaaaactcagcggcatcatcaggcgcgaaggcgaggtctgcatatgcatagaaacgctaagaacaacggggataaagatcgccaccacgccggttgaactcatgaaagcgccaagtccggcgacggtgatcatcagtaaaaccagcatcttgatttcactgctgcccgccattttaaccagccaggtaccgaccaccgtcgcaacgccggtgcgcacgaggccgtcgccaataataaataaggcggcgataagaatgacattcggatcgctaaagccggagaaggcttccggaagggtcaaggtaccgctaaggacaaaagcaacaatgacgaataaagccaccgcatccatacgtactttgcccgtcgcaaacaacacgacggcaatcgccagtaaagagagaacccaaatcaattcaccgttcacaacatatccttgtcagatgagaagataacgcgattctgccataaatatgccccgccaaagcggggcgatatcatgatcaggtctttcttaacaccaccacatcgccgtttggttgtttagcgaccgataattgcgtcaggctatccaacgcaaaatcaacatccgccagacgcggcgtgtcggccggcgcattgaccgcaatgacgtggcagcccgcagccagcccggacagcacgccagccggggcatcttctactacgacgcactcctgaggggccaggccaagcagttgtgcgcccagcaaatacgcatccggctccggtttgccgcgtttgactcgttcggcggtgacaaacacctctggcgctggaaggcccgcgacctgatggcgcgcacgcgcgaccggcattgaaccggaggtgacgatagcccacggaatgcccactttattcaggtgattgagtaaatcgactgcccccggcagcgcggtgatccctgcggtttcagtggcttctatttgctccaggcgcgtaaactcagcggcaatttccgcctccgatttacccgccataaaatgccgcaacgaggtgatcgcctgtttgccatgaataaagcccagcacctcatcatgagcaaggttaaaacgatcggcccagctacaccacgcgcgttcaacggcaggtaatgagtcaaccaacgttccatccagatcaaacagaaaacctttacactgcacgcgagcctcctcaggcattaatgatttgattgatttcattcgcgctcaggtggtactgacgcgggcaggcatgccagacattcaacatccgctggtatttttcccacatcggcgtctgggcattaaagccgtgtgtcccggcgtcaaagtgagtgtagcgtccttctatattcaccataaaacggacatagccgaggtagcgcgcttctgtcgcggcgtcaaaccccaggaaggtgacgcgacgttcgtcgatggcttgcgtatctttgaggttggtccaggagacgtgcagcgcatggtacatctccataatatcgatgatggtacgacaggtctcttccgtcagctcgccaaactcgcgatccagctcgcgcatctgcaggccgtagccgcgttcaataattgtttgtaagcgacggtaacgctcggcgttggtgggatcgagcatcgtcatcattttgtactggttagacaaaatcagacgttgcgcgttggtcatttccattttgaactcctgtatcacgctatggcgatgaaaaaaagaaggcattggtatgccttcttttatatgcgtaatccggggtcaattacaaatcatccaggaaagttttatccagttgtttgaaggcgcgcttaagcgtgtcagctaatgcctggtaatccggctttccttctaccggcgccagcgcttgtccagcctcctgcaatttaccgcgaacttcgtaaaaccagttaaggattgaaggcggcaacggcgtcacggaacgtttccctaaccaccataatccctgcatgggcaagctcagggcgaacagggcggtcgccacggccggacctaactgaccgcccagcgctatctgccagcataatgtaaagacggcgacaggcggcataaatcgtatggcatagcgcgtcatacgaatgacgcggttttcgacgaaaacgggcgccagccgtttttccatcggccacgtcttcgcgtagtgctgcccccggcgaaataagctaaaaaaatttacggagcgattatccggtgtcgacatggcctacctcaacttcacatataaaatttaaaaaatttgtgcaaaacaacaactgcgagggacaacgttcaaaacattttgtcttcgatacccactatcaggtatcctgtgtcggcctgtcaaaggccggtagtttaaaatcattgagtcgtcaatattacacatagtatgccattggctgaaaaatacgcaaaatggcatagactcaaaggtatttcttccatcatgcccaaaaaaactcctgcgcatgatgttaatcataaatgtcagggctatcatgcgctacgctctatggctcactgacgtttttttagccacgtatcataaataggtacttccatgtcgagtaagttagtactggttctgaactgcggtagttcttcactgaaatttgcaattattgatgcagttaatggtgatgaatacctttctggtttagccgaatgtttccatctgccagaagcacgcatcaaatggaaaatggacggcagtaaacaagaagcggctttaggtgcaggcgccgctcacagtgaagcgctgaactttatcgttaacactattctggcacaaaaaccagaactgtctgcgcagttaactgcaattggtcaccgtatcgtacacggcggcgagaagtataccagctccgtagtcattgatgagtccgtcattcagggcatcaaagattccgcctctttcgcaccgctgcataacccggctcacctgattggtatcgccgaagcgctgaaatctttcccgcagctgaaagataaaaacgttgcagtattcgacaccgccttccatcagaccatgccggaagaatcttacctgtatgccctgccgtacagcctgtataaagaacacggcgttcgtcgctatggcgcacacggcaccagccacttctatgtaactcaggaagcggcaaaaatgctgaacaagccggtagaagaactgaacattatcacctgccacctgggcaacggcggttctgtttccgctatccgtaacggtaaatgcgtggatacctctatgggtctgaccccgctggaaggcctggtcatgggtacccgttccggcgatatcgaccctgcgattatcttccacctgcacgacactctgggcatgagcgtggatcagatcaacaaaatgctgaccaaagagtccggtctgctgggtctgactgaagtgaccagcgactgccgttatgttgaagacaactacgccaccaaagaagacgctaaacgtgcgatggacgtttactgccaccgcctggcgaaatacatcggttcttacaccgctctgatggacggtcgtctggatgcagtcgtgttcaccggcggtatcggtgaaaacgccgcgatggttcgcgagctgtctctgggtaaactgggcgtgctgggctttgaagtcgaccacgaacgtaacctggcggcccgcttcggcaaatctggtttcatcaacaaagaaggtacccgtccggcggtggtgatcccaaccaacgaagaactggttatcgcgcaagacgcgagccgtctgactgcctgatttcacaccgccagcctcgctggcggtgctgttttgtaacccgtccccaaaagacggtaacgaaagaggataaaccgtgtcccgtattattatgctgatccctaccggaaccagcgtcggcctgaccagcgtcagcctcggcgtcatccgtgctatggaacgcaaaggcgttcgtctgagcgtctttaagcctatcgcccagcctcgcgctggcggcgatgcgcctgaccagaccaccactatcgttcgcgcgaactctaccctgccggcggctgaaccgctgaagatgagccacgttgaatctctgctctccagcaaccagaaagacgtgctgatggaagagatcatcgcgaactaccatgcgaataccaaagacgcggaagtggtgctggttgaaggtctggttccgacccgtaaacatcagttcgctcagtctctgaactatgaaatcgcgaaaacgctgaatgcggaaatcgtttttgtcatgtctcagggtaccgacacgccagaacagctgaacgagcgtatcgaactgacgcgcagcagcttcggcggcgcgaaaaacaccaacatcaccggtgttattatcaacaaactgaatgcgccggttgatgaacaaggccgtactcgcccggatctgtcggagatctttgacgactcttccaaagcgcaggtgatcaaaatcgatcctgctaaactgcaggaatccagcccgctgccggttctgggcgcggtgccgtggagcttcgacctgattgcgacccgcgctatcgatatggcgcgtcacctgaacgccaccatcattaacgaaggcgatatcaaaacccgccgcgttaaatccgtcactttctgcgcgcgtagtattccgcatatgctggaacatttccgcgcaggctcgttgttagtgacctccgctgaccgtccggacgtactggtcgcagcttgcctggccgcgatgaacggcgtagaaatcggcgccctgttgctgaccggcggctatgaaatggacgcgcgcatttctaaactgtgcgaacgcgcattcgccaccggtctgccggtctttatggtgaacaccaacacctggcagacttcgctgagcctgcaaagcttcaatctggaagtcccggttgatgaccatgagcgcatcgagaaagttcaggaatacgtcgcgaactacgttaacgctgagtggatcgagtcgctgaccgccacttccgagcgtagccgtcgtctctctccgccggcgttccgctaccaactgactgagctggcgcgtaaagccggtaaacgcgtagtgctgccggaaggcgacgaaccgcgtaccgtcaaagcggcggcaatctgcgctgaacgcggcatcgccacttgcgtactgctgggcaacccggatgaaatcaaccgcgtcgcggcatctcagggcgttgagctgggcgcaggtattgaaatcgtcgatccggaagtggtgcgtgaaagctatgtcgctcgcctggttgagctgcgtaagagcaaaggcatgaccgaaccggttgcccgcgaacagctggaagacaacgtggtgctcggcacgctgatgctggagcaagacgaagtcgacggcctggtttccggcgcggttcataccaccgccaacaccatccgtccgccgctgcagcttattaaaacggcgccgggtagctccctggtctcttctgtgttctttatgctactgccggaacaggtttacgtttacggcgactgcgcaatcaacccagacccgaccgcagagcagctggcagaaatcgcgattcagtctgcggattccgccattgccttcggcatcgaaccgcgtgtggcaatgctctcctactccaccggcacctctggcgcgggcagcgacgtagagaaagtacgtgaagcgacgcgtctggcgcaggaaaaacgtcctgacctgatgatcgacggtccgttgcagtacgacgccgcggtcatggctgacgtagcgaaatccaaagcgccgaactcgccggttgcgggtcgcgctaccgtgttcattttcccggatctgaacaccggtaacaccacctacaaagcggtacagcgttctgccgacctgatctccatcgggccgatgttgcagggtatgcgcaagccggtgaacgacctgtcccgtggcgcgctggttgacgatatcgtctacaccatcgccctgacggcgatccaggcttctcagcagcagcagtaacagtaaaagctaatgccggatggcggcgtgaacgccttgtccggcctacaggtgagataccgttgtaggccggataagacgcgttagcatcgccatccggcattctgctatttaccctgcaaagcggaattttttgcttaactgcgctgcatcaatgaataactattcccttcttctcatacttagcctctttgctttgcaacagggatagtctgtcatgtctgtcgttacagaatcaaaaacagccagaaaatgggcaatgcccgatacgctggtcatcatcttttttgtcgccattttaaccagtatcgccacctgggtcgtccccgttgggatgtttgatagccaggaagtgcagtatcaggtcgatggtcagacaaaaacccgcaaagtcgtcgacccgcactcttttcgcattgtgaccaacgaggccggggaagcgcagtatcatcgagtacaatttttcactaccggcgatgaaagaccagggctgatgaattttccgtttgaagggttaacatccggatcgaaattcggcactgccgtcggcatcattatgtttatgttggtgattggcggcgcattcggcatcgtgatgcgtaccggcaccgtggataacggcattctggcgcttattcgccacacgcggggcaacgaagtcctgtttattccggtgctatttgtcctcttttcgttagggggcgccgtatttggcatgggcgaagaggcggtcgcctttgcaattatcatagccccgctgatggtcaggctgggctatgacagcattaccaccgtcctggtgacctatatcgccacccaaattggctttgccagttcgtggatgaacccgttttgcgtagtcgtcgcccaggggattgccggcgtgccggtactttccggctccgggctgcgtattgtggtctggattgtcgccacgctgattgggctggtttttacgctggtctacgcctcacgcgtgaaaaagaatccgctgctgtcccgcgtccacgaatccgatcgctatttccgcgaacagcaggatgaagtcgtccagcgccctttcaccttcggtgactggctggtactgctggtcctgaccggcgtaatgatttgggtcgtctggggcgtgattgtccacgcctggtttattccggagatcgccagccagtttttcaccatgggcgtggtgatcggcctcattggcgttatcttccgcctcaacggtatgacggtcaacgtgatggcgtcctcattcaccgaaggggcgagaatgatgatcgcgcccgccttgctggtgggttttgccaaaggcattctgctgctggtcggcaacggcgaagccggggaacccagcgtgctcaatacgttgcttaacagtatcgcgcatggcatcagcgggcttaataatgctatcgccgcctggtttatgctgctcttccaggcggtatttaatttctttgtcacgtccggttcgggtcaggcggcgttaaccatgccattactggcgccgctcggcgatctggtcggtgttaaccgtcaggtgactgttctggccttccagtttggcgatggcttcagccatattatctatccgacatcagcctcgctgatggccacgctgggcgtgtgccgggtcgattttcgcaactggctgaaagtgggggcgtcgctgctgggactactgtttattatgtccagcgtggtcgtcattggcgcgcagatgatgggatatcattgatccaaaatgccggatgagcatcagcgccatccggcaatatctccatgattaaagcagtgatttcgcggcttctacaatcgcttcggcggtgagtccgtactctttttgtaagaaatcctgcgttcctacctgcccataacgctctttgacgccaacacggcgcatcggcaccggacagttttccaccagcacttccgccaccgctgaccccagtccattatggatgctgtggttttcacacgtgacgatacgccgcgttttttccgcgtagtttttcaccaacatgcgatcgataggctttaaggtgaacatatcaatgaccgcggcgctcacaccttcctgctccagttggcgcgccgcctccagcgcctccgccaccataatgccgttggcgataagcgtaatatcatcgccctcgcgcagtacgttgcccttgccaatggtaaaggtagagcctggcgcatagatactccgcgcctgcttacggatggtacgcagccagtaaaaaccgtccaggtccattagctggcgtaaaatatccgcgaacatcaccgcatccgtcacctccagtactacggagtgcgccagcccgcgaacaatccccatatcttcaaaagacatatgggtgccgccgttatggcacgctgtcactccggcatcggaggcgatcactttgacgttgttacgctgataatccagcgccataaagagctgatcaaaacagcgacggctggcaaaagcggtaaaggtatgcacaaacggtttacgaccggtcagcgccagccccgccgccgtgccaatcacattcgcctccataataccgcagttaatgacatgctgcgggtagtcacgcgccacgctgtccatcgccattgagctcattaaatcagcctcaagcgcaataattgggcttccggcctcaatctgcccggcgataaaaccggcgtaaactttgcgcatttcgatatcgtctttaagccctgcgggcgcaagcttaatcatgcatgacctccagttgatgaatggcctcattgagcgtctgcttcatgccatccgtcaggcgtaagtggtgagaattcgttaactgctccaggcatggcaccccctgccctttaatgctgtcaaggatcacaacccgtggctgggcatcggcgggcggcacaggctgaaccaccgccagtagtccggcgatatcatcgcctttgacggtgacgacatcgaaaccaaacgcacggaatttcccttccagatcgaatggattgataatctcctccagctcgccgtcaagctgctgtttattccagtcaatgaaaacggtcagattattcaggcggtggtgggcaataaactgaaacgcctcccagcactgcccttcattcagctccccatcgccgacaatgcaaaatacccggttgggtcgccgcgccagtttatgcgacaacgccattccgcccgcaatagagatgccctgtcccagtgagccggtcgtggcgtccacgccgcgcgtttttagccgatccggatggctgggaagacgggtgccgttctggttaagcgtattcagctcttcgcgcgggaaatagcctttaatcgccagggtactgtacaacgcggggcccgcatggcctttcgacagtacgaagtaatcgcgttccggccagtccgggtcggcagggtcgattttcatcaccgcgccgtacagaaccgccagagtctccactaccgacatgctgccgccatagtgaccaaagccaagatggtttaaggatttgagcgtggcgacgcgaatatcgcgcgccagttgggtgatttcggttacgttcattctttcgctccgctattttcctgcacttcggcagtcgcttttttgtttttggccaacacgttgtacgccaccagtagcgcgaatagcgccaccaccagccccgtgatagccatcggcgacagataacgcgccaggttgcccagcaaaataccgattacgccaaagtcagcatccgagaacgtggtattggcgaagccgatcgcgccgagaaccggcagtaacagcactggcaggaaagtgattaatagaccattagcaaatgcgccgatcatcgccccgcggcgaccgccggtggcattgccaaagacgcctgcggtcgcgccggtaaagaagtgcggcacaacgcctggcaggattaacacaagcttcatctgtccaagcaggaacagccccaccagcccgccgagaaaactgaacaggaagccaatcagtaccgcgttaggggcatagggatacaccaccgggcagtccagcgccggacgcgcgtttggcaccagtttttctgaaaagccggtaaaggccggaacaatttccgccagaatcagacggacgccttgcagaatgatgaatacgccggcggcgaaggtgattgccatgatgatggcgtacaccagatagttttgcccgccgctaaacgtcgcttcgacatactcacgccctgcgctgactgccatgatcagatagataatcatcatggtcagcgaaatcgagatagaactgtcgcgtaaaaaactgaggtttttcggcaggttcatctcttccgtggagcgggagcctttaccacacaggctgccaatccagccggaaagcacatatcccagggtaccgaagtgaccaaacgcaatgtcatcggtaccggtaatccgcctcatataacgttgagccaaggccgggaagaaggccatcaccagccccaggatcagcgatccggtgaagaccagccctacgccctcaaaccccgccacggtcaggattacgccaatcatacaggccatgtaaaaggtgtgatgcccggtcaaaaagatatatttaagacgcgtaaagcgtgccacgacaatattggccaccataccaaatgccataattaacgccgtggacgcgccatatttttccagcgcgattgagactatcgcttcattattaggaataatgccctgaatattaaaagcgtgttcaaacataccccctagcggatttaatgaacccaccagtacggttgcgccgccgccaagcacaataaaacctaaaatggttttaatcgtgcctttcaccacatcggaaaacgcttttttctgcgccaccagaccaatcagcgcaattaaccctacaagcaccgagggcacttttaaaatatcaacaacaaaattcagcgtttcaaggataaacatatccacctcgccagcaataattattgtttagcgaaccatgcgcgcagctgcgtttccagttcgttgatgtcgatgatgttattgatcaccaccagttggctttccggtacgctggcgctggccgcgatatctttggccattacaaaaagatcggcagccccgggcgtggccgatgaaagatcggagtgttccacctcggcgtcaatattgagtttctttaatacttttttaatgttcatttctaccataaaactactacccaggccggaaccgcaaattgccatgattttcattattgtcaccttttaaaagtagagttggtctgcatcacgcacgggcgtaatgttatttaccgcaagaaaatggaataaaatcagaaacggtcaataatcgttttaatgtcctccaggttttttgcctgatgtaatttttccatatctacatcactggaaaataattccgccagcgccgatatcatttcgatatgactgtgcttatcaggcgccgccagcataataatgatgtcaaccggatcgaattcgtctgcgccaaatgaaacgccgtgctgtagtttcagtaacgataaacctaaccctttcgccccctcttccggcctcgcatgcggcatcgctaaccctggcgctaatacataatatggcccaagcttttggtgctgctgaacaatcgccgtaaggtattccggtgcgataacacctgcgtccagcaggggtttgccgcaaatttccagcgcctgcggccacgtttccacgctctcctgtagcgtgatggttgcgtcagataaccaggttcccagcatgttattcgcccccacggtgtatgaaattatgaacaaactttattcaagccattcgatattagctgcgatcgttatcacaaagatagcgctaccagcgactattactcagaattgtgatagcgctatcaaattaaaatcatggtgtgaaatcacagcaaaaaagcggatttaaggcgtatactgccagtcatgcgaagcaaagaacgacaataaaaaagcatctcaacatgttgtaatgacgcaggaatttgtatgtcgataccccgtaaacggcgcagtaccggtaaagtgactatcgccgatgtagcccaacttgccggtgtaggcacgatgaccgtatcacgagccttacgcacgccggaacaggtctctgataaactccgggaaaaaatcgaagcggcagtgcatgagctgggctatatgcctaatctcgccgccagcgcgctggcgtctgcctcctcgcacaccatcgcaatggtcgtaccgaaccttgcggaagcggggtgttctgaaatgttcgccgggctgcaacaaattttacagcccgcaggctaccagattatgctggcggaatcgcagcatcgcgtggaacaagaggagaagctgctcgaaacgctgctggcctccaacattgccgcagcgattctgcttagcgtcgaacatagcactaccgtgcgccagtggctaaaaaatgcctctatcccggtgatggagatgggcgcgattcgcagcgatcctattgatatgaatatcggtattgataacgttgcggcaatgtatgagctgacggaaatgctgattcagcgcggttatcagaatatcgggctgctatgcgccaatcaggagcagtggatttttcagcaacatctgcacggctggtacaaagcgatgcttcgccaccatatgtcgccaaaccgggtgattaatgccgccttgccgcccaatttttctaccggcgcgtcgcaactgccggagtttttactggcgtggccggagctggacgcgctggtatgcgtatcggatgagctggcctgcggcgcgttatacgagtgccaacgacggcggatcaaagttccggacgatttagcggtggtcgggtttggcgatagcgatgtcagccgggtctgccagccgccgttaaccaccatggccgtaccgcaccgtaagattggcagtgaagccggacgggcgctgttggaaaggttaaatcagggaaactggagcgatcgaaaatccatcgcctccagtttatgtatgcgggaaagctgctaaaacgcttattccgtctcttccggtttctcctggagcgcggcttcgtttttggcgttgcgggtcatccacagcgccagcgctttgagcgaatctggcgtaaactcatcacagcgcgcggtgatctcctccggggtcagccaacacacttcgctgacttcatcttcctgaagcgcgaaaggcccgtgggaaacgcagctaaacagcgcgccccaaacccggcaatgttggtcttcaaagtaaaacagaccgtgttcggcaaacggcacgcctgcaatacccaactcttcttccgcttcgcggcgggcagattccagtagctgctcatcagcctgaaccacgccgcctgcggtagcatctaacataccgggcaaaaaatcttttgtttcggtacgacgctgcaccagaattttacccataccatcatgaacgacgatatacgtcgcacgatgccgtaagcgttgcgcacgcatctgttcccggctggactgtgcaatgacttcattgtcttcattcacaatatccacccattccgtacttgccaaacgacgctgttccaccatcaggaaaccttcttatttctggcgctcttacggcgcatttacgtttgtgaggtaaattacgagttaattgcaacctgcgcaatgatactttgatcattgagtgcgattacgctcaacacattatcatccagaataccgtagcttgccgcatacccgcctttcgggatgctcactgacccaggattaaagtgatacagtccttcctgctgttgcgccaccggcagatgcgtatgaccatagaccaacacatcgccagtatgcagagcgggcagattcgtcggcccgaagaggtgcccatgcgttaaaaatagccgcctctcttgcgtcaatatttgctgccacggcgcagttatcgggaaatgcagcagcatctgatccacttcgctatcgcagttgccgcgcacggcaatgatttgcgtcgccaccgcgttcaggcgttcggcaacctgagcgggcgcatagccttcaggcagcgcatttcgcggcccgtggttaaggacatcgcctaatatcaccagccaacgcgcgccgctttgcgcgaaccgctcaagcacgcgttccgtggcgggtaaagaaccatgaatgtccgatgcgaacatcagtttcatcgctcactcctcgttgtgaaaaacggcgttatgatactggaatatgaatagattttcagcctgaacgcttcgaggaaagcgcaataaaacgctgtacggaagcacgctgccactggaatgtcgcatatgccgccagcgatgccggcacgtcatcgccatgcagcgccagacgattgatcatcaatgccagatcggtatcggcaatgcaccattcaccaaataaattttgcgtcccctgccccaatagcgcttcagccgtcgcaaacagttttgccgcgctggcttttccagcctcgcttagcggcgcttttttcgccccggcaaacactacgtcggtaggccgttcttcgcgaagcggcagtaaatcgctgcgtagccacgcctgaatctgtcgcgcgcgggcgcgtttttgtaaatcgtgcgggtagatacgctcccactgcggcggcgcgaaacgctcctccaggtattccgcaatagcggacgactcgctcagctcaaaattgtcggcctcaagcaccggtacgcgctgcgtcagcgcatatcctcgccagccaggttgcagatgttctccctggtccagatcgcgagttttcagagtaaaggaaagccctttttcttgtaatgccacccaggcggacaagacgtagggagagaaaaagttcgcatccgaccacagcacaataacaggcttactcataatgtcctcttgagggcgtattaggtttcttcccaaaatatagcgtctttcgcctgctgtcacctgatgaaaactcacacacatcaggaggctttctatacttaattcagcccagactctttacgcacatgcaggagccaaaatgattgacctttactacgcccccacgcccaacgggcataaaataacgctgtttctggaagaggcggagctggcgtatcgtttgctaaaagtagatatcagcaagggcaatcagtttcgccctgattttttggctatctctcccaataataaaattcctgccatcgtcgatcacgccccggcagacggcggtcaaccgcttagtctttttgaatccggcgaaattcttctctacctggcggaaaaaagcggcaaactgcttagcggggagctgcgtgaacgccataccacgctgcaatggctgttctggcaggtcggcgggttagggccgatgctgggccagaatcatcactttaaccactttgcgccgcaggccatcccctatgcaattgaacgctatcaggttgaaacgcaacgcttatacaacgtcctgaataaacgcctggaaacctccccgtggctgggcggcgaccactacagtattgcggatatcgccagttggccgtgggttaacgcacatcagcgtcagcgaatcgatcttgatacctacccggcggtgtataactggtttgaacgcattcgcacgcgtcctgcgacagcgcgcgcactgttacaagcgcaactgcactgtaacagtacgaaagcgtaacgcggtagcatacatcatgtatgatgtagaggtgtatacacggaaaaaacctgcgtccggcacccttattcgtattaaaaacctgacattagggaagaggaaatcctccctactctggaggtcatatgcagattctgattaccggcggtacaggcctgatagggcgtcatctcattccccggctgttaacactggggcatcaggtgacggtcgttacgcgcaatcccgataacgcgcgtcagattctcgattccagagtgacattatggaaagggctggcggaacgtgagcacctcaatgagattgatgccatcatcaatctggcgggcgaaccgattgccgacaagcgctggacgtcgcaacaaaaagaacggttgtgccaaagccgctgggctatcacgcaaaagttggtggatttaattcatgccagcgcaacgccgccctcggtgttgatatccggctccgccacgggctattacggcgatctgggtgacgttgtcgtcactgaagatgagccgccgcacaacgaatttacgcataaactttgcgcccgctgggaacagattgcctgtcgtgcgcagagcgaccagacccgcgtctgcctgctgcgtaccggcgttgtcctggcgccgcaaggcgggattctggggaaaatggttccgccgtttcgcctcgggctcggcggtccggtgggtaatggtcggcaatatctggcctggattcacatcgacgatatggtcaacggcattctgtggctgctggataacgatcttcgcggtcccttcaatatggtctcgccgtatcccgtccataatgagcattttgctcatgcgctgggtcgcgcgctgcgccgtccggcgattattcgcattccggcgacggcaattcgcttattgatgggagagtcgtcagtgctggtgttgggcggacagcgggcgctgccaaaacggcttgaagccgccggattcgcatttcgctggtatgatttagaagaggcgctggcggatgtgattcgctagttcccaaagcgccgtatcctgcccggtgagcgatgcgccgccgggcttcttttatttcagcgagcctttcaggaattgctgtaaacgcgggctttgcggattgccgaacacctgctccggatcaccctcttcttcaattttcccctgatgcagaaaaataacgtgcgaagagacatggcgagcgaagcccatttcatgcgtgaccaccaccatcgttttgccttcttccgccagttgttgcatgatgcgcaacacttcgccgaccagttcaggatcgagcgccgatgtgggttcatcgaacagtaaaacgtcaggttccatcgccagcgcgcgcgcaatagaaacgcgctgctgttggccgccggagagatggacgggatatttgccctgagcgcgctcatcaatccccaccttcgccagatatttcaacgcccgctcgcgcgcgtcgtgcttgcttaatcccagtacctgaatcggcgcttccatcacattttccagcaccgtcatgtggctccagaggttgaagtgctgaaacaccatcgtcaggcgggtacgcaacaagcgtagctgatttttatccgccactttgagctgcccatctttgtcgcgcaccagattaatgttctgaccgttcacgataatcgcgccttcgctcggtttttcgaggaagttaatacagcgcaaaaaagtgcttttaccggagccggacgagccgatgatgctaatcacatctccggcgcgggcctgcagcgatacccctttcagcacttcatgaccgccgtagcgtttgtgcaaatcgataacgtgtaatttattttctgacatcatgttactcgaattatttagaggacacgtgctgcaaccagcgtctttccgcccgacggaacaggcttatcaggacatacgaaatgagtaaatacaacacggcggcaatgccaaacgcggtaaacggctggtaagtcgctgagttaatatcgcgggcgattttcaacaaatccggcaccgtcgcggtaaacgccagcgccgtagagtgcagcattaaaatcacttcgttgctgtaggcaggcaaggcgatgcgtaatgccgacggcaaaataatgcagcgatacattttaaatgacgagaagccataggcccgtgccgcttcaatttcaccgtgcggtaccgagcgaatcgccccggcgaaaatttccgtggtgtacgcgcaggtattcagcgtcagcgccagtacggtacagtttagtccgctgcggaaaaacgcgttaagaagatcggtgcctttgactatctccagcgtatacatccccgaatagaacaccagtagctgtacgtacagcggcgtgccgcgaaaaatatacgtaaacagccagatgggaaaacggatgaatttattactggaaacgcggcctaccgccagaatcaccgccagaagaccgcccatcaccaccgatgaaattaacagccacagcgtaatcgccacgccggtaaaacgatagccatccgtccaaagcagggatttccagtactcctgaatgatctcaatcacaaatcggccctcttcacgcccacggaatagcgacgctcaagtaagagcagcacaccattggaaacggtggtaaataccaggtagataagtccacagaccacggcaaaatagaaaggctcccaggtacttttaccggcaagctgcgtggctttgacgacatcttccaggcccagcagcgacaccagcgccgtcgctttgagtatcacctgccagttattgccgatccccggcagggcgtaacgcatcatcgccgggaacataatccgccggaaggtttgcccgtgggtaaaaccaaaggccgtcgccgcctcgatatggcctttcggcaccgccataaacgcgccgcgaaaggtttcggtaaaataggcgccgtagatgaaaccaagggtgataataccggccaccatcggatcaatatctatctggtcgatacccagcgaatcggtcaccacgttaagcgcgatttgcaatccgtaaaatatcagcagcattaagaccagatccggcaccccgcgaatcagggtggtgtacccttcaaaaataagccccgttacccggttttgcgaaagcttcgcccccgcgccgacgagaccgataagcacggccagcaccacggaactgagcgccagttccagcgtgacgatcgcgccctgtaaaattacgcctgaaaacccgtacaacatgcagcctgtcctgttgtgtgtggtgaagtaataagcctcttttgcatttttgcctcacatcacgccggatggcggctgtgccttgcccggcctacgatgctccccgtaggcctgacacgcacagcgccatcaggcaatgcagacagtcaacattctttgggctttatctgcaccgacggtgattaaccgccataaacatcaaaatcaaagtactttttcgccagcttttcgtaagtaccgtcagcacgcatttcagcaaaggctttgttcagcgcttcgcgcagctcgttatcctctttgcgcagccccataccggttcctacgccgaataacttctcatctttcaccgccgggccgccgaatttatagtcttttccgacgggctgtttaaggaaaccttcgctggccgcgacctcgtcctggaacgccgcatcaatacggccagccgtcaggtcggaataaatgttgtcctgcccctggtaagagacgatctcaatccctttcggcgcccagtgctcattgccgaaggtctcctgcgtcgtcccctgtagcacgccgacgcgcttgcctttcagcgacgcgacggtcggctgaatatcagagttcttcgccaccaccagacgggaatcagcggcgtaaagcttgtcggtaaacgcgatttcctgctggcgcttttcagtgatggacagcgaggacatgatggcatcaattttcttcgcttttaaagacggaatcagcgcatccagcgggttttccacgaacgtacactgtgtgttgatacgtttgcacagctctttggccagatcgatatcaaagccgaccaattcaccttgtgcatttttggattcaaacggtgcgtatgtaggatcggtaccgatgcgaatcttttgtggaatagcggcaaatgctgcggtagcgctggaaaatgccagcaccagagaaagggataacgccagttttttcataactatcctcaacagactgtctttccaggagatctttacagatccgatgcgactatcgtgccattaatcaggccgacaaggcaaagcattctaccttgtcagccggtttattttgcataaaaatcgattaagtatgcatttatgcgcctgttccgcaacggcttatgcaccaaaaaggtgcaaaacatctattttgcaccgtgatagttccccagcgcggcgcgttatccccttccctcaatcgccgtaaacattaaaatcgaagtactttttggccattttgtcgtaagttccgtcctggcgcagttcggtcagcgctttatcaaacgcggcttttagctcggtatcatctttacgcagcccaacccccgtcccgtcgccaaaatattttttatccttcacggaaggaccggcaaacgcatactctttgcccgctggctgcttcaggaaaccttcgctggcggcgacttcatcctgtaatgcggcatccagacgaccggcggttaaatcggaatagataagatcctggttggcataagccaccacatccacacctttagtgcgccagttatcattggcgtaagcctcttgcgtggacccttgcagcacgccgacatgcttgcctttcagcgattccagcgtcggctgaatgggagacccttttgccgcaatcaggcgtgaatccgccgcgtaaagtttgtcggaaaacgcaatttcttgctggcgtttatcggtgatagagagcgatgaaataatggcatcaatttttttcgcttttagtgagggaataagcgcatcaaagtcgctggcgacccaggtacatttcacctgcatacgcttacacatttcattaccgagatcgatatcaaagccaataaactcgcctttggcatcttttgatgagaaaggcgcgtaggtggtatctgttccaatacgaaccgtttgcgggagcgcggcgtaactggccgccgtcgcgcccagacctatcagcaaagacaaagcgagaacggtcttcttcatacatacccctcaagtggcgtcattttcttatgttttacgtggcgttgtgtgtttgcagactttttcatgcaggtcttatgccattttcacgtcagcaaaacgattcgacgttaaatttgttaataaaacgttgcaatattgtcctgatgttgaagatagcaggtatgacggttgaaccgcagcgtttcggcggcttttaacgaattaaatgttgaggatatgatcgcggttacaaaattgccctgaaacagggcaacagggacaataatgcacgctaaacagacaacgctatgcgccctgccagcgaacaaaaagatcgtgcggaagggggatatcaaactgatccagcactcggttaaccgtttgatttataacatcatctaacgtctgaggaagatgataaaaagccggaaccggcggcataatcaccgcgcctatctcagcggcctgggtcattaaacgcaaatgcccgatatgcagcggcgtttcgcgcacacacagcaccagaggtcgccgctcttttaatatcacatccgccgcgcgggtaagcagtccgtcagtataactgtggacaatccccgacagcgttttaatcgaacagggcaagataaccattcccgccgtcgggtaagagcccgaggaaatgctggcggcaatgtcgcgcgcatcgtgcgtcacatcggccagcgcctgcacctcgcgcagcgaaaaatgggtctccagcgccagcgtttgccgggccgcctggctcatcaccagatgcgtttccacgctatcgacatcgcgcaaaatttgtaataagcgcacgccataaatcgctccgctggcgccgctaattcctacaatgagtcgtttcatgttctcttaccgtttacgagcgccgttcatcccactgtgttacgtaatcggctcaaagtgggtctgaagagataccatgacaaaagaatccctatcataaaagccagctcaaccaacattatcactaccccctgctcactaaaccaggtgccgaccataatggcaaaattggtgataatgacaaatcgggccgtccaggggaaaagcggcgatcgatagcgtagcaaatcgctggcgtacgttccattacgcaccgattgtcggaagcgatactggcaccatccgatggttatccatgccaggcaacccacctgcccggtactggcgatcagatataaataaaattgctgtgcgggaatatagcgggtcagcaacgacactaacgccaacaaggccgtgattaaaatagcatacaccggcacgccgccgccgttcgttttaccaaagcaggctggcgcaaagcgatcgcccgccatagaccacagcatacgcgaactggcgtaaatggccgagttagcggcagaaaccgcggcggaaaagatcaccagcgtcatcagcgtatccgcccccggaatgcccgcgtgggagaatacccatacaaagggactttgtccatttggcgtcagttcatgcggatagaccagcgccagcaccgcaatcgccaggccgtaaaacaaaatgattctgagaccgatccccaggatcactttcggtaaaataatgtgcggcgattcggtctcccctgccgcatttcctaccagttccaccccctggaaggagtaaatcacgatcgtcatataaaccacaatttgctcccaaccgtggggaaaccacattccgtctgtttttaacgtcgggtgccagtcactatggcccattagcgagtagatcataaccccgcccgcgcaaataaacagcacgatcgcgaaaaccttaatggccgaaagccagtattcgcattcgccaaaactttttgcggaggtgagattgatggccgtcaggatgagcagaatcgccaggcagaacatatataccggaaccgcggggaaaaactggtgagcaataaaccctgcggcagtgaggtcggccgccagggaaaagacccagctaaaccagtaaagccagccaatggtatagctccagcaaggtgacggcataaacatcagcgcgtaatgttgaaatgaaccggagtgaggaaaggcgcatgataattcgccaagacacatcatcgtcgccagcataatggttccggcaaacagataggccagtaaggttcccgccggcccgacgctgcttaacggttcggcaatgccgataaataagccggtgccaatcgtgccgcccagcgacatcatcagcaggtgccgcttcttcaggttacgccgcagaccgccttcaggctctgctggcggagattgttgcagggtatccatcgttactccctgtctttcgtgaggtcaaagatgccgccgcgacatagccgcggcggttatgcgttaacgcgtaaacctccaggcgacgcctttggtctggcaggccattaacaggcccgtataatccagctcaaagcgaaccacatcgcctacttttagcgactgacgacaatcttcaatatccaccagcgtatgatcgctggtttgtcctaagatagtgatagcgtcgtcgcatggcacacagttatccgacggcacatcctggcgaccaaacgccagcaatgcgcgtcggcgtatgccacgatcgacaaaggttttactttgcaaaaaggcatcgacgcccagctccccgaccgggacggtaggtttactgttcagttcgatgatttccgcttccaggatatacatatcggaacaggctttatcgaccggttttgcggagtggtgaaattcattcaggtatttcatgtccacatattcaatgccgaattcatgcagtccgccgatgcgcagatgattcagtccctgcggccagatacctttatccagcaggtgatagctggtgcagtttcccgcagaaagccgccggacaggaataccgctgtcagcttccagccgggcggccagcgccagaaaatcctcgccattttttaccgttggcaacacggtgccgtaacaattaaagttggtgcccagtccatataattccagaccgggcagaccagtaatcagagtcacggtctcaagaatgcgttgatattcaccaaaccagataccctcgcgtaaatcgcccatatccaccatcagtaatacctgatgcgttttcccctggcgttgggcttcttgcgataatgcccgtaataccaccggctcgctatttaaactaatatccgcgtagcgcaccacatcttcgatttcactcagacacggactgcgtaacaggcaggtcgtacatcctgtctcgcgtatttttttcaaattataggttcgtgattcagcgataacggtaattccgccgttgaacaccgcctgcgcggtttccacgcagccgtcaaaaactttattgacagccatcacgtcaataccgctacttgccagcagagctttttccgtgcgggcgttttcttccagcttgcgtagatttatttccagaactggcatatacattttattttcctcccgccatgcttaaacgggcattacgtttctgcgcccgatggtaaatgtactccgcgacgacaaccgccagcacggctccgccaataattttcccggcgtactggaaatatccgcccatatcaatttgagaaggcggaataaataacagcgcaacggcaaaggcgatagaaagaaagcccagcgcgggtaaaatagccggtaaaaccttgcccggaattttaaaacttcttggcgtatccggctgagtcttacgtaaacgccagaacgctgggaacatcaccaggtaaggaataaaataggtgatggtcgttagcgccgttaacatccagtaagccgccgcaacgcttggcgaaataaaagtcgaaaaacacaggaccgtgacaataatcgcctgtacagtcaaggcaaaggcgggcgttttccacaccggatgtaatttgccgattcggtcccccagcagattatcttcacgcgaggcttcctggagcatataaatcggccccaccagccaggagttaatctgcccgagagcgccaaaaaacatacagatggccataacaggaattaaccacggcatatgcagcgtatccgcagcagcatgcatagcctgcatgacgcctgccacgatgtcggttttcccggcgggtaaaagcgtatttagcgcccaggtgccgaccatatagatcccgacgataacggcggcggagacggccatcgctcgcggaaaatcacgctgtggattacgggtacgcccggcaatcatcggggcgacctccagtccggcaaacgcaaacatcatgctggataagaaaacgatcgtatcccagtgtccgagatccggaatccagtttttcgctgtagtgtagtccgtctgcatctggtgtccggtacatagccatactaccgccagcaaaatgaggatggcggagggaataaatacgccgcaccaggcgctgatgctattaataatttttgtccattccatcccgcggatattcatcagcgttaatagccagaaaattaccgcggaaccaataccgataaacgctttattttccgccaggccgccgccgatcatatagcccaacgcggtaaagccgaattgcagcattaatgggaaaaacagtacgcaggaaaagagaaaacaaaccacgacaatccatgcaatacgtttaccaaatgcctctttaatccagacaaatatcccgccatctttcggccagccggttgacagctcgccgcataccatcgctaaaggaaaaaacaagcagaatgcggcgatcacccataacaacatggccgatgccccgtaaggcgccacgttagggatttgccgcaaactcagaatagcgatgacattcataaagacaatgtctttgatgccaagtaagccagaattcgtgttactcatggccatctcctgttatgcattcaggcatcactgccctcttcttatcatctgacgacgggcttcagcatgaaactgaagcccaaaacagtattaataaatgtcgtacttgaccatatcttcgtaactgtcttcccgacgaatcagacgcgtgtcaccatttttatcgatcatcaccacgcccgtgcgcggacggttgttataaacggtttgactttcaatggtgtatgccccggcatcaagaaatgcgacaatatcgccaacatgagtctccttcggcagtaaaaactcttcgcctttcactcccatgtggaaataatctccgccatcacacagcggcccggctaattttatccaggcgtcgtgcgctgccgtcatgcgagaggcgttatagacataaaagaaccagtcaaaatgctggctgtcagagagtacgctgtaaccagcgtcgacaaatttccattcaacgtggcattccacattgccgttaagatcgtaatttgttttacgtttttcgcaggagacttccgtaagtaaaaccgccgccgacccggtcactttacgtcccggttcaatacatatttccacatcggtacgccatttatgcacttcgcgaatgaccgcatcggcaaaatcctgggcggtaataccggcatacatattatcttttaacgggtcgccattctcgtcgtcatatttatagggaaccggaattccgccgcccacgttgatcaaatcaaatttaataccaagcacctcttccaggcgacgggattcatccaccagcactttagtcgcttttgcgaaaggctctgactccggcacctgatcgcccacatgcatatgcaagccgcgcaaatgcacataaggcatcgccagaatgcggcggcaggtttcttccgcctgttccaggtcgagacccgacttcgcatggaaagcggtaaccagttccgcatgcgtcgccgagggaacattcggttctacgcggacgcaaacattggcgactttcttcagcttgcgagagatggcatcaatatgttccagctcatacaggctatcaacattaataagatacagatcgttggcgatggcatattccagatcggcaggctttttcaccacgccgttgaagacgatctgatcgccgcgaaagcctatctccaggcacttgcgaacctcatattgtgagtttgcctccgcgcaaattccggcgtcacgaatggctttcaacacccccatgaccgagcaggtttttgacgcaaagaaggttttggtatttttatgcgccgcaaatgcctgctggatttcatgaatgttacgaataatctccggctcagaaaacacatagaacggcgtggggtactggcgcgccagagcgtccagatcgaccccttcaaaacacaaatgaccgtctttgtgctggaaacggcgatcgccgttgattacctgctcacgtagctggttgtaattctgcataatcgagtcagtcataacgccctctgcttaatgtttatggtaaaaatccgcattctttacagggataaagcaaaaggcatgccactattttttatcaaaataatcaattagttataaaaataagctttttctcattttcgtcattgagtttgctattcatcacaacgacgaaaattcgtcacttttataatgacaacatgaacaatagatatgaggaatgcatatatggcatccaccaatcaggagctggcctcggcgctcaggatgttttcccgctttttcgatttgattcatcagccgttggccgtcattaatgagcgtggtgaatacgtttactacaatcaggaaagcgcggatctggacggctatagtattgaacgggcaatgggaaaacatatgctggatgtctatccgggcatgaaagagacgcaaagtacgatgctttcatcgttaaaaaaaggcgtggaatacattggccattatcaaatttattacaatgcgcgaggccaggccgttgactatcagcacaccaccgcgccgctctatgcaagcgatggcggcatggtcggcgttatcgaaatcggcaggaatatgtccggcgtcaggcggctccaggagcaggtggtagaactgaaccaactgctgtatgccgatcaccatgagaagcaccatgccattattaccgaaaatccggaaatgctcagtaatatcgccaaagccaaacggctggccgccagtaatattccggtgacgattgtcggggagacgggaacgggtaaggagctattttcccgcctgatacatcaatgcagcaagcgggcgaataagccatttatcgccctgaactgcggcgctctaccgcctacgcttatcgaaagtacgcttttcggcaccgtgcgcggcgcctataccggcgcggaaaatagccagggctatctggaactggcaaacgggggaacgctctttcttgatgagctgaacgccatgccgatagagatgcaaagtaagctgctgcgattcttgcaggataaaaccttctggcggctcggcggacaacagcaactccactctgatgtcaggatcgttgccgccatgaacgaagcgcccgtcaaattaattcaacaagaacgtctgcgggcagatcttttttatcggttgagcgtcggaatgttgacgttaccgccgctgcgcgcccgcccggaagatattcccttactggcgaattattttattgataaataccgtaatgacgtgccgcaggacattcacggattaagcgagacggcgcgtgctgatctgctcaatcacgcctggccgggtaatgtcaggatgctggaaaacgcgattgtacgcagcatgatcatgcaggaaaaagatgggctgctcaaacacatcatttttgaacaggacgagttaaatttaggcgtaccggaaaccgcgccggaaaatccccttccctcgtcacccgatccgcagtatgaagggtcgctggaggtacgggttgccaactacgaaaggcatttaatagaaaccgcgctggatacgcatcaggggaatattgccgccgcggcccgcagccttaacgtatcccgcaccacgttacagtacaaagtacaaaaatacgctattcgcttcggcgtggtgcgtaattgacatcggccagcggcattgcgccgctggcaaagccattagccttcgttatgcatttccaggttttccatttcgttctggaacagcaccgctttggcgtcgtcattacgtaatgaatccaggaagtcgaggtattgctggtctacgtctttggtgacatatatcccgttaaataccgaacactcaaactgctggatatccggattttccgcgcgtacggcttcgatcagatcgttcagatcctggaagataagcccgtctgcgccgatgatctgacgaatctcatccacctcgcgaccatgcgcgatcagctcattggcggtcggcatatcaatgccatagacgttggggaaacgaatttccggcgcggcggacgccagataaaccttcttcgcgccggcttcccgggccatctcgatgatctgctctgatgtggtgccacgcacgatggaatcatccaccagcaggacgttcttatcgcggaattccgcgcgattagcattgagcttacggcgcacggatttacggcgtagctgttggcccggcatgataaaggtacgtcccacgtaacgatttttgacaaatccctggcggtacggcttgccgagaatacgggcaatttccagtgcgatatcgcaggaggtttccgggatagggatcacgacgtcgatgtccagatcttcccattcacgagcgattttttcgccaagtttggtgcccatattcacacgagcgctgtagacggagatcttgtcgataaaggagtccgggcgagcaaaataaacgtactcaaacagacaggggttactgaccgggttatccgcgcactggcgcgtgaacagttgccccttttcggtaatatagatagcttcgcccggcgcgacatcgcgcagaaactcaaagcccagcgtatccagcgccacgctttcagaagcgaccatatactccgtacgaccatcgccaacgtcacgcttgcccagcactaacgggcgaatgccgtgcggatcgcgaaaagccaccatgccgtggccgataatcatcgccacgcaggcataggcgccacggatttgacggttagtcgcggcaatcgcggcaaaaatattgtcggcttccagcggatagtgacggaagttgtcgagctcgctggcgaaaatattgagcaggatttcggaatcggaggtggtgttgatatgacggcgcttttcttcaaacagctttttacgtagctcgtgcgcattagtcaggttgccattatgggccaacgtgatgccatacggcgagttaacgtaaaaaggttgcgcttccgaagcgctggagctgcctgcggtagggtagcgcacatggccgatccccatgttgccctgcaaacgctgcatgtggcgagcttcaaaaatatcgttcaccagcccgtttgccttacgcaagcggaagcagttattcgcatcaatggtgatgataccggcagcatcctgaccacgatgctggagcactgttaacgcgtcataaatcgactggttgaccggcataacaccggcgataccgacaataccgcacatacgtcattttcctcgttaagccacatctcagaacctgttacgtcctgggcaagaaactcgacgagctttgcagatagtcaaagaaccatctgatgatgaagctgaactgcgggatgagctgcgatttgctccagtcttcgcttttcgacaagccggtaaaggtatcaaggaagaacagaatggcggcgacaatcagcgcgcctcgcagtgcgccgaaacagatccccaacacccggtcagttcccgacaggccggtcttttctactagctgacctatcacaaaattcacgatagcgccgacgataagcgtcgcgataaacagtaccgcgatagcaatcccattacgaaccagttcgtcttcaaagcccgtaaaccagacagacaggtaagtgtagtagtgactggcgacaaagaaagcacaaccccacgtcaccagcgataacgcttcacgaacaaagccgcggatcaggctaaccagacaggaaaaagcaatcaccgcgataatggcgtaatcaatccagaccatagatgtcccacgattttacgccctgtcgtcctgttcggggcgcattctaacagaaaaagaaaacgtttgcgtagggatttccttcccacgcgtaaataaaaatggcgctgaaaaaatattcaacgccatcacactttttatctcttcgggcacgaccagaagagctgccatcggcctgataagcgcaggatacccggttcattccttctgccggatggcggcgtaaacgccttatccagcctacagaacttcggctattaccagatgaacaccgtaggccttaacgctgcgcgctcaggcaaaacgcgccttagttcgggctatatcccatcaccacgccgcttaacccggaaatctgcttgagctcgccaagcgatcctttcatcttatctttcgacgcatccggcccgacgagaatacgggttattttaccctgtaccggcgttgagggggaagtataaacccggaacccggcggaacgaagcttgccgactatctcgttgactttatccgcgtttttcagcgcgcccaactgtacgacataggctttgccggtcggcgcaggtttatcgtcggcgactggttgcggcgcgggcgtcggcgtggaagcggcgacaaccggctgttgcggtttaggctgcggcttcggcttttcaaccggcttcggtttaggcgtctccaccggtatcggatcaagctcgacattgttagacgccatgcgcgacgggtccagcgacggcgctgccgcatctcccgcccgcacctcttcagccgccccttccggcggctgtgtcggcagcgcctgcgttgcggcaggcatcatatccggctcatcgcggtcgccaggcttcggtaccagtggaatcgcagcaaattcatcctgataatgctttttctgtccgtccagcagaccgggaagcacaataacccccagcgcgactaacacaatcgtgccgactaaacgattctgaaacttactcgccaccgattctccccgcgtctatcacttccataacatgtgcgacggtgtggaacgatccgcacaccagcacggtatcttctggctgcgccgcgtcgatagcggcctgccatgcctgcgcgacgctatcatagacattccctttccccagatgttccagaagttgttccgccgtcgcgccgcgcggcccctctaacggagcacaataccagtcgtcaaccacgcttttcaaccaggctaacgtgccggcgatatctttatcatgcagcataccaatcaccgcaagcacgcgcccgcgtttcggcaacattttcagacgacccgtcaggtattccgccgcgtggggattatgggcgacatcaaagataacgcgcggcgactcactcacgatttgaaaacgtcccggcaaggtagcctgcgcaataccgtcgcgaatcgcctgctcgtcaatattcaacctgctggcgcgcagcgcggccagagcggtggcggcattcggctgaggaacctgcggcaacggcagtccggcaagcgtgccgtcgccatcggtaaacgcccagtgggtcgctgtcacctcataacgccagtcaacgccgcgacgccgcaacagcgcgccggtctcctgcgcgacatccgcgatggttgccggcatttccggttcgccgacgatagcgggtttttccgcacgaaaaatcccggctttctcgcggccgatactttcgcgatccggccccagccagtcagtatggtcaagcgcgatgctggtaattaccgctacatcggcatccacaatgttcgtggcgtccaggcgcccgcccaacccgacctccagaatcaccacgtcaaggttagcctgtttaaacagccacaatgccgacaacgtgccatattcaaaataggtcaatgaaatatcgccgcgcgccgcttctatttccgcaaaggatgcggtatgcgcggattccgctaattctttcccctgcacgcgcacgcgctcggtgtaacgtaccagatgaggcgaactatagacgcccacacggtatcccgccgcgattaacaccgactccagcgtgcgacaggtcgtacctttgccgttggttcccgcaacggtaaaaacgaacggcgcaggcttgaggatgtccagacgcgctgccacctggcttacgcgctcaaggcctaaatcgatactcttgctgtgcaggttttccagataagaaagccacgaggccaggggcgacgcagcttgaggtatagatttgtttttcattgtttacgctgcttctttacggtgaaaagcaaaagggcagagcctgcggccctgcccttttcagttatcaggcctcagactcctgatccggcgccggaggcaccaccacgccttcacgcggggcgtccgggttcggcgcgggcagattcatcagcttcgccagaatgctcgccagcttcaggcgcatttccgggcggcggactatcatatcaatagcgcctttttcgatcaggaactcactgcgctggaatcctggcggcagtttttcgcgaacggtctgttcgataacgcgcgggccggcgaagccaatcagagcttttggctcggcgatgttgagatcgcccagcatcgcaaaactggcggaaacgccgcccattgtcggatcggtcaataccgaaatgtagggcagaccacgttcctgcattttagccagcgccgccgaggttttcgccatctgcatcagcgacatcagcgcttcttgcatacgcgcgccgccggaagcagagaaacacactaacggacagttgtcttccagcgcctgttcaacggcgcgaacgaagcgtgcgccaacgacagaccccattgagccgcccatgaacgcgaattcaaacgcggcggcgacaaccggcataccgtgaagcgtccctttcatgaccaccagcgcgtctttctcgccggtttctttctgcgcggacgccagtctgtctttatattttttggagtcgcggaacttgagcacgtcttttggctccagctcgctacccaactccacaagggaaccttcatctaacaggctatgcaggcgattgcgcgccgacatgcgcatatgatggtcacacttaggacagacctcaagattacgttccagctcagcgcggtataaaacctgaccgcagctatcacacttggtccacaccccttcaggaatgctagccttgcgggtgggagtaatgttgcttttaattcgttcaatccagctcattggtgacctttctgcctgaaccttagtcagctttattataaggggcgcataatgccatttttgcccccaacagaccatgaatgttgcacattaaaacataacagcccgaaactttggataaaaaagtggtcgaaccgctgagttactttctattttgcggcacgcgacgcagcgcgcttatgccggacaatctcaatgacgccaggtaatatcgaaaccacgataatccccacaatcagcagcttaaggttatcctgaatcaacggtatcgtaccgaagaaataaccggcgtaggtaaagagcagcacccacagcagcgcgccgatgacgttataggcggcaaaatgccgataggacatgtgccccatccctgccacaaacggcgcaaaggttctgacgatcggcacgaagcgagcgagaatgatagttttaccgccgtgtttttcataaaactggtgggttttatccagataactacggcggaaaattttcgaattcggattactgaacagtttttcgccgaacagtcgaccaatcgtgtaatttaccgcatcgccgacaattgcggcgatcagcattaacgccaccatgacatgcacattgagatcgttggtttccagcgaagccagcgccccggcgacaaacagcagcgagtcgcccggcaggaacggcgtgacgaccaggccggtttcacaaaacagaatcaaaaacaaaatagcgtacacccagacgccgtactccgcgaccagctccgccagatgcacatcgatgtgcagaataaaatcaataataaagtagatcaggtccatatttgtctttgcctttctacccgacacgtttcgggtgtgcgattcggattagtccgccagaaatagcgggcccattggcggttttggaaggtcaaaccggtcagggtaatccaccgcaaccaaatatagcccttccgccttcgccgttgccgccgccagcgttctgtccctggccgctaacagctctgcgatccagctctccggctggttgtgagcgcctacttccagcaggctgccgacaatattcctgaccatatgatgaacaaaggcattcgctttgatatcgaccaccacataagggccgtggcgggtaacgttgatgtgcatcacattacgccacggcgtgcgcgactggcactgcactgcgcgaaacgaggtaaaatcattttcgccaagcagacactgcgccgcgcgatgcatccgctctgcatccagcggctcatagtaatgcgtcacgccttttgctaataccgcaggacgcagtcgatgattgtagatgatatagcgataacggcgagccgtagcgctaaatcgcgcgtgaaaatcatccggtacagttttcacccagcgcacggcaatgtcaccaggcaaattcgcatttacccccagcgtccatgccgcatctttgcgcaatgcggtcgtttcgaaatggacaacctgcccggtgccgtgaacgccggcatcggtacgcccggcgcagaacacgttaataggttcatttgccacctgcgagagcgctttttccagcttttcctgcacgctgcgcacttcattctgacgctgccagccataatacttgctgccgtcgtactcaatacccagcgcaattttatagaccgccgatgattgctgtccggacatcagtacagatactcctgcaccagcttctccgcaattttaacggccatcagcgcgccgccgaaacgcacgttgtccgccactgaccagaactgaatttgttccggcataccgtaatcattatgcacacagccaatagagagctgtggattgccggaagcgtcgcccacctgcgtcgggtaatccgtctcttctgacagtacgatatcttcaccgcgggaaaatgcctcgcgcgcctcttccgccgccagcggacggagcgcttcaaagctcaccatctgcgcatggccatagaacaccggcgactgcacgacactggcggagatcatcacgccatcgtcctgcaaaattttacgcacttcatcgacgatacgacgttcctggcgcacgctgccttcccgatccggcagcagcggcagcatattgaacgccaactggcggccaaagaaatcatcttcatcaatcggtatgccgttaagcaacttcgcactctgtccggccagcgcatcgaccgcttttttcccctgtgcggacgctgataacatactggtgacggcgatgcgcgacagtcccccctgatcgattaacggcttgagcgccgccagcagttgactggtcagactatcggcgaccgcaatcacgttacggttacggtaatccgccagtacatacgggttaacttccggcacgaccagcggcacatcaggctccagcgcgaacagaccgctggaatctatcaccaggcaacctgcattagtcgcgtcgtctatccaggcagccgatgcctctgcgccggcaacgaaaaacgccaactgcgcctgcgtccagtcaaagtccgccgcatcctggacaatgaccgacttgccaccaaaacggaggtgctcgcccgcgctttcatgacgcgccaacgcataaatttcaccgaccgggaactggcgttcagccagtgtttcaagcagggcttcgcctacggcgcccgttgcgcccagaatggcaatgttccagccttcagacatggtgatttactccagaaatacataagcgtccctgtcgcattattcgacagggagcattaagaagacattaatgtgccgggtgatgaacagcgttaaaacctagcttacacagcaaggcggctgccgtttcgtcgtcacacatcacgtataaagacgaccattcacggcgctcaagataatttttacgcaatttatcaaattcacccggaattccagcgactttacgcagtggcgcatcgtcgcggcgcacatcatacaccaaatgcgccagtcttttcagcgtcggttgatccagcgggccatgaagcgtaatacgaccaaactcaggcgcaggcagtaatgtctccagcgcgacacgctgctcgcgaccgataaacgcgctatacgcctcaaagacctgggtggtgccgcgcgctttgccttccagcgtatagccggcaatatgcgacgtgccgatatccacggcttccagtagcgcgacgttaagatccggttcgccctcccacacatcaagcaccacgctcagcggctgcccggcattaagtcgcgccagcaacgcggcgttatccaccaccggaccgcggcaggcgttaatgagaatggcgccgggtttcagtcgacggatcagcgtctcatcggccagatgcagcgttttgtacggtccgtctttatagagcggcgtatggaaagtcaggacatccgcttcctgcaccagctcatccagcgtacgaaaatcaccctcgtccccgcgtgcggcgcgtggcggatcgcacagcaacgtgcggatacccaacgcttcaagcctggtctgtagccggcttccgacgttacccacgccgacaatccctatagtgcgatcgcgtaacgaaaagccgtcacgttcggccagcatcaacagcgcggaaaacacatactccaccacggcgatagcattacagccgggcgcggctgaaaaaccgatgcccgcctgcttcagccatgcctcatccacatgatcggtgcctgccgtagcagtaccaacgaagttaatcggcgtgccgctcagcagcgattcattcactttcgtgaccgaacgcaccattaacgcatcggcatggttcaattcttcaacggggatcgggcgacccggcactgcctttacctcacccaggcggctaaataattcgcgggcgtaaggcatattttcatcaacgagaattttcacgactgtcgtacctgtttgagaacgagagttaaccggacaagtgtgccataatctggccgccaggcatatattgctcagatttatggttaaaggataattaattatgcatcccatctccggcgcccctgcacagcctccaggcgaagggcgtaatcctctttccgctgcgagcgagcagccgctttccatgcaacagcgtacggtactggaaaggctgatcacgcgcctgatttcactgacccagcagcaaagcgcggaagtatgggccggaatgaaacacgatctggggataaaaaatgacgcgccgctactgtcgcgccacttccccgccgctgaacagaatcttacccagcgtctgggcgtagcgcagcaaaatcacgccaatcgtcaggtgctttcacagctaacagagctgcttggcgtcggaaataatcgtcaggccgtcagcgattttatccgtcagcaatacggtcaaaccgcgcttagccagcttacgcccgatcaactcaaaaacgtgctgacgctcctgcaacaggggcagctttccattccgcagccgcagcaacgtccggcaacggatcggccattattgcctgctgaacataatacgttgaatcagttggtgacgaagctggcggccgcgaccggcgagtcaaacaaacttatctggcaatcaatgctggaactctccggcgtgaaaagcggcgagctcattccggcaaaacagtttacccatctggcgacatggctacaggcgcggcagacgctgtcactacaacacgcgcctacgctacatacgctgcaggctgcgttaaaacaaccgctggaaccggacgaactcacagcgatcaaagagtatgcccaacacacttatcaaattcagccgcaaacggtgctgaccaccgcccaggtgcaggatttacttaaccatattttcctgcgtcgcgtagagcgggaggcggatgagctcgaaccgctctctattcaacccatctaccgcccgtttgcgccgatgattgaaaccgtgaaaaatctgtctgcgcgaccaggcctgttgtttatcgcgctaataattgtactggcgcttttctggctggtttcttaaccgcgccggaacgataatatcgtcaccaggatgccaaccaccgcggagatcgctcccgcgaggaatacggaaggatagccgtatgacgtggccagcatgcccgccagcgggccggtaacgccgtaggagatatcctgaaacgcggcgtagccgccgagcgccgtaccgcgtacctgtgcaggtacgcgtttcacaacctccacgcccagcgccgggaaaatcagtgaacaccctgccccggtgagcgccgcgcctaccagcgctatccaggccgtcggcgccagccacaagagcagcaaccctgccgtctcaaccagcaatgagacaacggcgaccttcacgccgccaaagcggtccggcatccaaccgaacaatatgcgcatcagtacaaacgcaccgccaaacgcggtcagggtgaatcccgccatcgtccagccattgctgacaaaataaagtgaaataaacgtaccgatgacggcaaagcccacgccctgcaatgccaggcccaggcccggtttccagataagcccgaccacgctccacagtgaaggtcgctcccccgtatacgcaggcactttacgcacggtgccgttgaatgcccaggccagcagcggtaaaaccatcgtcgtccccgccagcgccgcgaagccaaagtggctatggatcagcaagcccaacggcgcaccggccgccagcgcgccgtaaatcgccatcccgttccacgacatcaccttaccggaacgcgttgggccaaccagccccagtccccaggtcagggttccggtcagcagctggctttcgccaaatccgaggatcaaacgcccgacaataagcagcgcgaattttactggcgcggaaaccggcaacagcgcggccaggagccaggcggcgcccgccagcccgcaggcaagcatcccctgtaacgccgatcgtttagcgccatattgatccgccagccgtccggcatagccgcgcgtcagtaccgtcgcaaaaaactgaatgcccacggcgatcccaaccatcgtattgctatagcccagttcgtgatgaacaaaaagcgggatgacgggtaacggcaggccgaccgtcatataggtcaggaaaaccgcaaaggcgatgcggaacagcgaaaaattcgcagacggggtcgttgttttttggctaactgctgtcatgcattactccagaatgcagagtaaggcggggaaaggccacgcccccctctacctgaacgtcaggattaaggtgcgttggataacgttaaacgcttacgcattatcggaaggataatgtagaaagtgaagtctgcctgtgagacgcgaaacttgtcaaccttgaaattgcagccagggtatcaacgtggcggcgtgtcatcaaacagaaagggaaagaccgctttcatccctctcaccttaaaccgtccggtcacctgcttgcgctgttctggcgtcagtaacctgaacatcatctcccagatatcttcaggctccgcttcctgtaaggaaatgggttccggcgtcggttcctctccgctgtcgtccagataacgatgaacataaagagggaaaacagatatatgaaactcctcggcctttgatttaacacgcttacgcctgacaccctctttcccttcgctgtacttatacaaacgttcgcgaaccgcaggctcgcttcccggaaaccccggtaagccaagacattccttaaccgtgaaccattcctttgccatcggtttctttcctttcccctgatgaaataaaaatatttcttctttttcgcgaaattttgctttctttctggcactattctcagagtgaaaaagaaagtaactttctttttctcgcgctaatttttaccttaaaaatatcggtgccgataacacatcttcttaggattacagaatggaaccaaaaagccaagactggcatcgtgcagatattaaaagtgcacttgaaaaaagaggtattacgctcagagatctttctcgtcaggccggtttatcacctgattcactgcgcaatgtctttacccgttcctggccgagagctgaacggattattgcggacgcgctgggcatcacgccgaaagagatctggccgtcgcgctatgatgatatgcaaataaaaaatgatgccgatatcgcagaataatagttaatgctgaataaattggctttaacctatcaatctcaacaattaataaatatttaaacttattatattgaaaatagtaatagcactatctgtcatgcttcccgaatcaaatactgttaaagcattacgtcattgctattacgtattttattaacaggaatcattatgagttgggataaaagaatggcggttaattatgccaaaacgcatgcaggttctcattctcaaggccggtgtgcggaatttacccgaaaggcaattcaggcgggcggtatcacgctggggcatacatatcatgcgaaagattatggcccaatgttaagaagcgccggattcaccgctattggtacctatgaaatgccgcgcgagggtgacgtcatcattattcaaccttacgctggcggaaacccgagcggtcacatggcgatatacgatggcacagagtggtattcagattttaaacaacgcgatatgtgggccggcccgggctaccgggcagccaggccctcatataccatctacaggaagaattaatgaaaacgttctcccttgtcgcgcttatcctgttgctttgtagttgctctgcgcctcatcacgacagtacgcaggccgtgaagcagttctatacctcatggatgacgacgttcacgaacgatgtgaatacccctgacgacaccaccgccttaatgcaacgttacgttgctaaagaggttattcatcgcctggcgctaatacagtccctttatgaacaggagattgtgggggcagattattttatgtatgcgcaggactatgcgccagagtggattccacagttacgggttgggaaggcacaccctttcctcggcggagaaaaagtggatgttctgttggctacagagtcaacgcccatccacctggaagtttatacccgttgggaagagggacgctggaaaatttaccgcgttcgggatgctgacaggggttatgaacagccgatttatgacgcaggcgccatcacccaggctgaggcctggtcagcgaaagtcgcgccggaatataagaagcattaaaaaagggaaccgccatcggtctcttgttcgtaccggagaggttaaagcgcctcttgcatcaggctcttattccgtcgctgaaaacagtaagccgaaaacaacccaggcattatttaaaatatgaagtattatcggtatcattagcccacggcttctcattcgaacaacgcataatatcgatgaaaaaacaaacagataaacaaaagtcaccgcaaagagatattgtgtatgcataaatgcaaaagcgagtgaagtaataataataccggaagctcttgagtaccgaccccaaccgatactgctgtttaataaaaaccctctgaatataatttcctccgccacaggagccagaaagcacatcgccagcgtgttaagaaatttatgaagaaaaaattgccttgataactcggccatccagggttccgggccactaaaagcattgtagagaacggtaaggcacaccagggccagcgccggaacaaaacactccacgaatgataagcgacccaatgataaaaacgggtaatactttgaataaatactccaggcggcaatcgcatagacaaaaacaatactatatataaaaggcgcagccagacctcccaaataaagccaggcataggaaggcgaaaatgaggcaaaaacaaaaatgccgaacaaaccaaataaaacagccacacaactcaaactatgcctaattttatctaatgtattagttggcatttatataatatccatataatttgttgttccctgaatgaaaaaacaggtcgcattagcgacctgtttcattgttgatactacaacgtaatagtcaggcttacaacttacgcatcaccagcgtggcgttggtgccgccaaaaccgaagctgttagacattacggtagtcagttcacgctcggtcgtttcggtcacgatgttcagacccgcagcctgctcatccagctcttcgatgttgatgctcggcgcgataaaaccgtgctccagcatcagcagagagtagatggcttcctgcacgccagccgcacccagcgagtggccggtcatcgctttggtcgcggagatagccgggctgttatcgccaaacacttcacggattgcaccgagttctttcacgtcgcctaccggagtagaggtaccgtgagagttcaggtagtcgatcggcgtgtctacgccgtgcatcgccatctgcatgcaacgtactgcgccttcaccagacggagcaaccatgtctgcgccatcggatgttgcgccatagccgacgatttccgcatagatatgcgcgccgcgcgccagagcgtgctccagctcttcgacaacaaccataccgccaccgcccgcgatgacaaacccatcacggtgcgcatcataggtacgggacgctttttcaggcgtatcgttatatttggtggacagtgcgcccatcgcgtcgaactcacaggccatttcccagcacagctcttcgccgccgccagcaaaaacgatgtcctgtttgcccagttggatctgttcaaccgcattgccgatacagtgtgcggaggtcgcgcaagcggagctaatggagtagttcacgccataaattttaaacggcgtagcgaggcaggcggaaacgccggatgccattgctttcgtcaccacatacgggcccacggctttcaaaccacgcgggctacgcatggcgtctgcgccaaagacctggaatttcggggagccgccgccggaacctgcaatcaggccgacacgcgggttattctgatagacttccggcgccagaccggcgtcggccactgcctgctccatagacagataagcatagatggaggcgtcgctcataaagcgcacgactttgcggtcaatgaggccagtggtatccagttttacgttgccccatacctggctacgcatgccggcgtccttcagctcctgagagaaagtgatccctgaacgtccttcacgcagagatgccaggacttcctgctggttattaccgatgctggaaacgatgcccaggccagtaatcactgcacgtttcattcaatacctctgtaattcgcactatttttaagtttcgattggcacaatagcgtacacttgtacgccgaacaagtccgatcagccatttagtacggaaatttgcgccatcaggcacacatcgttaagatcgcgataccgcccgtcagacgagtaacttacgtgaaacaatacgccatacaacccgccacactcgaatttaacgctgagggtacacctgtttcccgagattttgatgatgtctatttttctaatgacaatggactcgaagagacacgctacgtttttcttggcggcaatcgtcttgcggagcgatttcccgtacattcacatccattatttatagtcgcggaaagcggttttggcaccggactcaacttcctgacgctgtggcaggcgtttgacagctttcgttctgcgcacccacaggcgacgctgcaaaggttacatttcatcagttttgagaaattcccgttaacgcgcgacgatctggcgctggcgcaccaacactggccggagctcgcgccctgggcagagcagctgcaggcgcaatggccgctgccgctcccggggtgccaccgcctattgctggatcggggccgggtgacactggatttgtggtttggcgatattaatgaattgaccgaccaactggacgccacgctaaatcaaacagtcgacgcctggttcctcgacggttttgccccggcgaaaaatccggatatgtggacgccaaacctgtttaacgcgatggcgcggctggcgcggcccggcgcaacgctggcgacgtttacctcggcgggtttcgtccgtcggggattgcaggaagccggttttaccatgcaaaaacgcaaaggcttcgggcgtaaacgcgagatgctttgtggagtgatggaacaacacctcatgccgaccctttccgcgccctggttttaccgcagtggaagcgaaaaacgtgaaacggcgatcattggcggcggcattgccagcgcgctgttatcactggcgttactgcgtcgcggctggcaggtgacgctctattgcgcagatgatcagcccgcccagggcgcttccggtaatcgacagggcgcgctttatccgctccttagcaaacatgacgccgccattaatcgctttttcccgaccgcattcacctttgcccgtcgcctgtatgatgccctgcccgtctcttttgatcatgactggtgcggcgtaacgcagctcggatgggatgagaaaagccagcagaaaattgcccagatgctgtccctggcgctgcccgccggactggcctcggcgctcaatgccgaagaggcggaacaggcggttggcgtgacgacacgctgcggaggaattacctatccggcaggcggctggctgtgcccggaacaattaactcgcgcagtcatcgcactggcgaccgaacagggtttacaaacgcgctttcgccatacgctcacgtcgctcgttgcgcaggagtcgcgctggcaactgcgctttacgtcaggtgaaaccgccagccatgagaccgtcgttctggcgaacggccatcagattaaccgttttgatcagacccagccgctgccggtgtatgccgtcggggggcaggtcagtcatattcccaccacccccgctctctcggcgttgcgtcaggtgttatgctacgacggctatctgacgccgcaaaatccgcataatcagcagcactgtattggcgccagctatcaccggggtgacgaaagcaccgtctggcgcgaagaagatcagcgtcagaaccgacagcgtctgcttgactgttttccggatgcgaaatgggccacagaggttgacgtcagcggcaacagcgcccgttgcggcgtgcgttgcgccacccgcgaccatctgccgatggtgggcaatgtcccggattaccatgccacgctgacgcattacgccgatttagccgataataaaacgtcggcggcgcctgcgcctgtgtatccgggtttatttatgctcggcgcgctgggatcgcgcggtttgtgctcagcgccattatgcgcagaaattctggcggcgcagatgagtaacgagccgattccactggatgccggtacgctggcggcgttaaatccaaatcggttatgggtgagaaagttattgaagggaaaagcggtgaagtaatgggtcagtcaatagcggaaggcggcaagcgtcgccttccggcccacggcgttattgttttgccttgtcgaacaaattgtcccacatcgctttgactaacgcctgatcgcgcggcgacagttcgccggcgccgatcgctttttccagactttggctaacgttggcatagaccgcctcaacggagtggtcatcaccgctctccagctcggcaatggctaacgtcaggtggccacgcaggtatccactggcaaaaagctcatcgtcgctggcgtgctctaccatatcgtcaattaatgccagaatgcgtgattcaaactccgcgatcatcttctttcctcattgtaaacgtggcgctggctttaattaagcgcttccggccacgggaactgttccgccttaagttcgggcgtgtgatagtaattctgtagcgctttgatgaagcgggccggacgttcaggaatgccctgctccagatacgccattacctgcgcatgaacccggcgctgaaacgccacgcgatccggttcaatatcgccttccagattgtcgcaactgacgttaaagggataccccgccgccacgcaaaacaaccagtcgaaagcctgtggcttcacctcaacgtcttcgaattgactttgggtctgcgcgtcgcgtccgtccgggcagtaccagtaaccaaagtcaaccagttcgcggcgcgccttaccggcgatacaccagtgagaaatctcatgcagcgcgctggcgtaaaacccatgcgcaaagacgatacggtggtacggtacctgcgcgtcagcaggaagatagatcggttcgtcgtcgcctttaatcagacgggtattaaattcttcggcaaagcagccgttaaaaatctcaattaactgttcgtaatggtgcgtattgttcattaattcatccccaaccagtggaggatctcctgtccgtggctatcataaagtaacctggcgctcattaccgccgagacaataacgatcatcggtctgataagcttttggcctttgctcaacaccagacgcgaccccattcgcgcccctaaaaactgaccaaccagcatcacgaagcccgtcgcccagatcactttgccgccgatgataaataacagcaggccgccaacgttggaggtagcgttaagcactttggcatgtgccgtggatttcgccaggttatagccacataaggtgacaaacgccagagcgtaaaacgacccggcggcaggcccgaaaaagccgtcgtaaaacccgacgcatcccccggctatcagcgcgaacggtaatccatacaggcggcgctggcgatcttcctcgcccagcttcggcatcaataaaaaatagaggccgatgaaaatcaccaggatgggcaagatctggcgcaaaatatccgcctgcacgtgctgcaccagcagcgcgccgctcatcgagccaatgaacgtcatcagaatattgagcttttgctcggccaggtttaccactttacggcgaataaaatagagcgaagacgagagggagccgccgcacgcctgtaatttattggtcgccagcgcgtttgccggcgacatcccggcggccatcagcgcagggatagtgagcagccctccgcccccggcgatagaatcgataaatcctgccagtacggcgacaaaaaacagcaccaccagcagcagcggggagaccataaacagatcataaaaattgtccatcagagtacatgctcatccagtagcgcctggcaggaaggcggcagcggcggcggtgtcttcttctcaggctttgtggtgccaggttttggcggttcgaaccagctttgcagttcagcgccgcatccatcgcccggcgggggtaaaggttgatcttcgcactccaggctgtcggcagggcagcgtaaacgcacgtgcatatgcgcgcgatgctggaaccaggggcgtactttacgtagccagtcacgatcgtttccggcatcgaggcaaagctgttgtttaatagccggattgacgaaaatacgggtgacgtcattgtcttgtgctgccagtttgatcagactggcgatatccgacgaccagcgcgacggcacgacatgtttaccgtcgcgggacaccagatctaacgcctgcgggcgcaatagctgcgcctggctccagcgcgttttcggcaactgcaagaaaatatccacatcaagcccggtctgatgactggcgtgtccgccattaaagcggcctccggcaggcatccccatgtcgcctatcaggacggttccgagcccccgttgctgcgcctgatgactcaaccgctggataaacatgaccagatccgggtggccgaaataacggcgctgatcggtgcgcatcacctgataattatcggactgtaccggcaacgtgtcggcgccaatgatgcatccgttggcaaagctaccgatagactgggcggcgccggggacaggatgggttattttctgccacggcgtcgccgccaggctggcgctactgacaaaccatgccagcagcgcaatcgcggtttttttcatttcttaccagcgtggaatctctgtctttacatccgcattctgtgcccgatggcgcagcaggtgatccatcagcacgatcgccagcatggcttctgcgatcggcactgcgcgaatccccacacacggatcgtggcgccctttggtgatcatttcgacttcttcacctgcccggttgatcgtacgtcccggcacggtaatgctggaggtaggtttcagcgccatatgcgccacaatgtgttgcccgctactgatgccaccgaggatgccgccagcgtggttgctctgaaaaccctgcgccgtgatttcatcgcgattctggctgccgcgcagcgccaccacgttaaatccttcgccgatctccacgcctttcaccgcattaatgctcatcagcgcatgggcgatgtccgcatccagtcggtcaaataccggttcgccaagccctgccggcacgccgctcgccatcaccgtcactttcgcgccgatggagtcaccctcttttttcagcgcgcgcatcagttcgtccagcgcgtcaagtttgtccgcatcgggacaaaagaacggattaagctcaacctgacgccagtctttaatctccagcggaatgtcgcccatctgggtcaggcagccgcggatttcgatgccgaacttttccgccaggtatttcttggcgatcgcccctgccgctacgcgcatcgcggtttcacgcgcggaagaacgtccaccgccacggtaatcgcgcaggccgtatttctgctcataggtgtaatccgcgtgtcccggacgaaaaacatctttaatcgcgctgtagtcctgcgagcgctgatcggtgttttcaatcagtaggccaatgctggtgccggtcgtcacgccatcaaacacgccggagagaatttttacctggtccggttcgcggcgctgggtagtatagcgcgaggtgccggggcggcgtctgtcgagatcgtgttgcagatcggcctccgtcaacgggatgccgggcggcacgccatcgacgatacacccaagcgccagcccgtgtgattcgccgaaagtggttacgcgaaagagttgtccaattgtgtttcctgccatcacggctccgttatcgttgttgtcgtttgcgtgttttaatctttataaatattgaaatgttcacgggccgcgagcaactgcgctttggtcaacataaagacgccatcgccgccgttgtcaaactccagccaggtgaacggcacatccggatactgctccatcagatgtaccatgctgtttccgacttcacaaatcagaacgccgtcatcggacagataatccggcgcatttcccaggatacgacgggtcaatttgaggccgtcagtgccggacgccagccccagctcaggttcgtggcgatattcgttcggcagatcggacatatcctccgcatcgacataaggcgggttagtgacaatcagatcgtactgaactttcggcagatcgcggaacagatcggaacggattggcgtcacgtgatggataagaccgtgttcttcaatgttatgctcggcgacagccagcgcatccggcgaaatatcgaccgcatcaacctctgcgtccgggaaagcataagcacaggcgatggcgatgcagccgctgccggtacacatatccagaatatatttcggctgttggctaataaggccagcgaagtggttattaatcagctcgccaatcggtgaacgcggcaccagcacgcgctcatcgacataaaattcgtggccgcagaaccaggctttattggtcaggtaggcgaccgggatacgctcgttaatgcgacgaatcactcgctcgacaatgcggtgtttttcgctggacgtcagccgcgcggtccgcatatcttccggaatatccagcggcagataaagagacggcaacaccagttgtaccgcttcatcccacgggttatcggtaccgtgtccataccagatattcgccgcgctaaagcggcttaccgcccagcgcaacatgtcctgaatggtatgcagttcacttactgcttcatcgacgaaaattttatccacgtattcctccagggcatgctcgcattaaattcggcggctagtttgccacgaagacagggataaatcagcattgacgcggcgggagaatacgaaaaatccgttttgaccgttcggatatcctccgggtcgggtaaactaaggcaaaagatcagacgagacccacgaatgaaaaagaaaacatcgctcagcgaggaggaccaggcgctgttccgtcagctgatggtcggcacccgaaagattaaacaggatactatcgtccatcggccactgcgcaagaaaatcacggaagtccctacccgaaggttaattcaggaacaggcggacgccagccactatttttccgatgagttccagccgctgctcaatacggaagggccggtaaagtatgtccgtgaagatgtcagccatttcgagctaaaaaaaatgcgccgcggcgactattcgccggaactgtttctggatttacacggcttaacgcagcttcaggccaagcaggaactgggggcgctgattgccgcctgccgtcgggaacatattttttgcgcctgcgtcatgcatggacacggtaaacatattctgaaacagcaaacgccgttatggctggcgcagcatccgcatgtgatggcctttcatcaggcgccgaaagagtacggcggcgacgccgcgctgctggtgttgattgaagtggaagagtggcaaccgcccgaattaccctgatgcggaattgccggatggcggcgcaagcgcctgatccagcctacgaacagccagcgctgtcgtaggcctgataagcgaagcgccatcaggcagcaaagattaaatcgctttcgccattttcagattgcagggactcatttgccagttgaatgtccccttgccgctttcatcaagcgtaacgttggcaattgcggacgtcgtgaacatcggcggcgtttcgcccggacaaagctcagataccaggtatccgaccagaggtaagtgagaaatcaccagcaccgatccgatctcttcattggccagcgcctggaggtaggcgctgaccagaccgacatcgccacagggcgttagctccggcaggacatccacctgagccggcagattcatacaatcgccgaccacatctaacgtctgttcggcccgaagaaacggactcaccagaacacgttcgatatccactttttgacctttcagccagttcgccatcaggcgagactcgtcacacccacaaggggtcaagggacgaaccgaatcactggcggcatcgagggctgcgtcgccgtgacgcatgataaaaacttgcatattgcaccgcttttgttaaccagtttcaccaacacgcttaccacatgcccctattggctgcggcaaaaatgcggtggccggcattgtgccttatccattcactgaatgaaacgctgttttttacctcaatggcgtaagtatagtcaatccttgattattatttcgccactaaggaggcattcagtgcggattcatattctctttgacctcaatttccctggtcagtttccccattcgtccagaaatgctccctgcgctccgccatgcgcactaattgttcacaaggcgcgtaacgaggaccgtaaagtgcggccaggcgctgtaatgtcgccaccatttcacccggcccgagagcatccatatagcggaacgggccaccgagaaacggcggaaaaccgataccaaacacggcgccgatatcgccatcgcgcgcgctgcgaatcactttttcgtcgaaacagcgcgccgcttcgttaagcattaacatgacacagcgctctgccacctgctgcgcagacaatcgactctgcccttgcacgccaataagcttataaatagcagggtcaacctgttttttgcttttacgccctttttcgccataaagatagaaaccgcgaccattttttctacctttgcgatcgtcattcaaaattgaagcgacaacatttgcaggcgcgctaaaacgttctccatacgccgcctcaagcacaggaataattttagtgcccgtgtcgattcctacctcatccaaaagttggattggccccaccggaaaaccaaattttaccagggcggcgtcaatatgttcgacgcgttcgccttcagtcagcatccgaatcgcctcattgatatatggcgcaagaattcggttaacataaaacccggctttatcactgacgactatcggggttttaccctgttttttcgccagcttaacggtcgtggcgatggtctgcgcggaagtagacgcatgaggaataacctcaaccagcggcattttttcgaccgggctaaaaaagtgcaatccaatcacctgttccggtctggccgcattcgccgcaatatcgccaatcggcagggaagaagtattggaggcaaaaatggtgtgagcagcgcaattttgctccacttccgccaccatctgttgttttaacggcagatcttcaaacaccgcttcaatgaccagatcacgatgactgaaaccacggtaatcggtcgaacctgatatcaacgccaactgtttatcgcgttcgctggctttgatatggcggcggcgtacttttgtttcaagcagatcccagctgtacttcagagcatgattgatcccctgagtatttatatccttaattcgtactggcaagccgcctttacaggccgtaacccaggcgataccgccgcccattaacccgccgcctaagatgcccacgctgttcagcgggccgggcggcgcatcgctaccgggatcttttttcacctcggtactggcaaagaaaatagcgcgcagcgcctgcgattgaggcgtcatcgccagctcgccgaaagcgcgcgcttccgcgtcatagccgctactgctgccctgcgccagtccagtttcaatcacatcaatgatccgctccgtcgccggataattaccctgcgttttttgcgctgtctttttacgcaccaggcgaaataacagcgcgcgccccagcggccccgccaggatacgttcacggaccggtaatgtccgctgcgccaggcgttcttttttagccagctcgacagccgcttccagtaaaatagtttgcggcaccacatcatcaaccagcccggctttaagcgcctgtctggcgcgaagctgtttacctgtcaggatcatatccagcgcggtactgacccccaccagccgcggaagtcgctgcgttccgcccgatcccggtaaaagccctaactgtacctccggcagtccgagaacggttttaacgtcgtcggtacagatgcgccgatggcaggccagcgccatttcaaggccgccccccagacaggcgccgtgaatggcggcgataaccggaacaggcaacgcctggatctccgccatcagttgctgtccctgacgcgccagcgtttccgcttcctgcgcgttttggcagtgacctatcatgttgatatcagcgccagcaataaagttatctgctttggctgagataaaaacaacgccctgcaacgctttattttcccggatctgcttcaggatggcgcgtacctgcgtggcaaactccgctttcagggtgttcaccttttctccagggacatcaatagcgacaaccgcgacattatccagacgcacgttaagcataaaagctgatgtggtagtcattattccgcctccagaaccatcgccgcgccaagaccgccagccgcgcaggccgtgaccaggccaaaacctccgccccgacgccgtaattcatgcaacgtttgggttatcatccgcgcgcccgttgcggcaaaaggatgcccgtaggcgattgagccgccgagcacgttgaatttagcgtcatccacctcccctgtcgcctgcgcacaaccaagcacctcacgggcaaatcgttcgctgcccagcagttgtaagttcgccagagtctgagcggcaaacgcttcatgcatgtcaaaaagcgtcagatcggccatcgtcaacccggcccgctccagcgccagcggcgttgaccaggccggccccaatagcatgtcctgccagacatcaatagcggtaaaggcgtagctgcgcagataaccaagcgggcgcagccccagctctttagcgcgggattcggtcatcagaataacggcggcagcgccgtcggtcagcggtgtactgttggcggcggttacggagccatgttttcggtcaaaagcgggacgcagtttagcgtagtccgccagcgtggaggcgccgcgaatgttgttgtcttctgcaaaggggtttttatacggcggcacataggtcgtcatcacttcttccgccagtttgccctccgcccatgcctgcgcggcgcgctgatgtgaacgatgcgccagcgcgtcctgctgttcacgcgtaataccatacgttttcgccatctgttcggcggtatcgcccatgcgcagaccggtggaatactcagcaacggcgggaggaacgggcagcaggtcgcgtaagcgcagacgagaaaaaagcgtcagccgttggcgggtcgtccgggctttattgacatcaaccagtacccgcgccagggctttactcacgcctattggcagtaccgacgacgaatctgcgccgccagcgataccggcgcgtatcgtgccggccatcaggctttccgccacattcgctaccgcctgaaaactggtggcgcaggcgcggcttacgctataggcatcggtatgaacattcatccccgtacccagcacaatttcgcgcgcaatattgggggcttccggcatttgtactacctgaccaaaaaccagttgctcaatggcatcggctggaatttcactgcgcgccagcagctcgcctaccaccatcttgccgagatcaacagcgggaataccatgaaatgcagtggcctgacgagcgaagggggttcgtaacccactgacaatagcaatgcgatcgccctggcgggtgaccaacggtaaagcctgacgcatagtactcccctgtaaaaaaataaattagtggtctgacctgatcacagtcttaaccaattttttacatttagccaagcagagagaaaagaaagtgggagctaaggcacagtgaagggaagcgacaaaaaaagaaaacgcctccgccagatgatgacggaggcgtcgtgaatgaacggattaacgcaggccgagctggaagatcagcgtttctgcttcgcaggcgaaaacaaaatcaatatccagacgaacgccttcggattcctcggtaaaggttggcgtaatttggcaaggttcagactccacgctacgcgctttttcggttaacgccgccagcgtctcttcagcctctgcgcgggtagcgaatacgcggctgtatgacgcggtgcaatcggagttgtccatgatggttccaacgtccatacagcagcaaaccggggtttcatcagcactgcatttactcattgtagatttcctctgtatttgcacccagggtgccagataaacgatggggatattttacgctcccggcattcgcctctccagtcgttaatggtgggaaacgcgttaagtgaccgaaatcacacttaaaaatgatctaaaacaaaaatcgcgcgatcgggtgaccgttaagcccgccgattttgccagccagatctcgtttctaagatcacaattgaaaaaacttataaacatacttgcaacattctagctggtcagacctatactctcgccactggtctgatttctaagtcgtaccgcagaccctacacttcgcgctcctgttacagcatgtaacatagtttgtataaaaataatcaatgaggttatggtcatgagccagaaaaccctgtttacaaagtctgctctcgcagtcgcagtggcaatcatctccacccaggcctggtctgcaggctttcagttaaacgaattttcttcctctggccttggccgggcctattcgggtgaaggcgcaatcgcagatgatgcgggtaacgttagccgcaacccggcgttaattaccatgtttgaccgcccgacgttttcagcgggcgcggtttatattgatcctgatgttaatattagcgggacatcgccatctcgtcggacgttagatgcggataacatcgcgccgacggcctgggtgccgaacgtccattttgtcgccccgattaacgaccagtttggctggggggcttctattacctctaactatggtctggcgacagagtttaacgacacatacgccggcggctcggttggcggtacgaccgatcttgaaaccatgaacctgaatttaagcggcgcttatcgcttaaatgaggcctggagcttcggcctcggctttgatgcggtatacgcgcgtgcaaaaatcgaacgttttgcgggcgatttaggccagttggtcgcggcacagaatccggcgctggcgccggtcgcgggtcagattcccagcgacaccaagattgcccacctgaacggtaatcagtggggctttggctggaatgccggtatcctttatgaactggataaaaataaccgctacgcgctgacctaccgctcggaagtcaaaattgactttaaaggcaactacagtagcgatcttcccatcgctataaaccgatttaacctgcctatcccaacggcaaccggcggcgcaacgcagtcaggctacctgacgctgaatctgccggaaatgtgggaagtgtccggttataaccgtgtggcgccacagtgggccatccactatagcctggcctataccagctggagccagttccaggaattgaaggcaaaatcgaccgccggcgatacgctctttgagaagcatgaaggctttaaagacgcttatcgcattgcgttgggtaccacctattactacgatgacaactggacgttccgtaccggtatcgccttcgatgacagcccggtaccagcgcaaaaccgttctatctctattccggaccaggaccgtttctggctgagcgccggtacgacttacgcctttaacaaagatgcgtctgtcgacgttggcgtctcttatatgcatggtcagagcgtgaaaattaatgaaggcccttatcagtttgaatctgaagggaaagcctggctgttcggtactaactttaactacgcgttctaatctctttctgaaacggatcaaaaaggtgagcattgcgctcacctttttatttactgccgtttattccgagtcgatctctttgagttcgtcctgaatcgcctgcgcgttcgggttttcctgcggcttgagttttccgccattggcgataaagtcatgacgctggaagtacgcctcgcgcaccataatataaggatcggaagactggcgcagcaaaccatcggagtccagcaactgcgcgcgggtttctatcccttcgatagtccattttcctatggacattggccaggtcaaccacgagagcaccggatacaaggtatccgccatatccccgccatcttcacgcagcgtgaagctgccgtagaacggaagttgcatataaggcccataccccacgccataatggcccagcgtactgccaaagcgatgcggttcaacgcgctgcagcttaggattcgccattcccgcgacgtcaataaagccgcccatccctaataaggtattcaggaagaaacgggtgaaatgcaccataccctgataaggatcgccctgcaggaaatagttcaccatgatcgccggttcttcgaggttgccggtgaaattacttaaaccgttacgcgcaggctgtggaacataatcacgccaggcgaccgcgaccggccgaacaacatacgggtccagcacattaaagttgaagttgtacatggtgcggttaaacccttcaaatgggtctgaacgcccctgctgttctgtaccggaactcgcacacccgaccagcagtgtggttcccagcgccagcgccgacaggcgaagcttcatagatgtctccctgtgaattatggctatcgctgattgccatccatgacggaacgctaccgtatccgcctgtttaggtgtgagcgattttaacagcacgtcaaacgatgtctatatgcgcgatctcattgctttgagcatagcctggtaacgcaacaacgtgacggccctattctaacgaaacagataaaaacgagcgtgatcatttttattttttcggagaatgccccggcctgggtaaatgaaaaaccgctacgctttattaatatgtgttaatcagcagagatcatcatggatagccttaacgacgataaaattaaccggcacagcagtgacctggaagttgaaagcgaagaaaaacaaagcggtaaagagattgaagtggatgaagatcgtcttccttcccgcgccatggcgattcatgaacatattcgccaggatggtgaaaaagagatggaacgcgatgcgatggctttgctctggtcagctattgccgcaggactttctatgggggcatcactcctggcgaaagggatttttcacgtgcagcttgaaagcgttcccggcggctttttactggaaaatctcggctatacctttggttttatcattgtcatcatggcccgccagcaattatttactgaaaacaccgttaccgccgtattgccggtaatgcaaaatcccactctgagtaacgttggcctgctgatgcgcttatggggcgtagtcttattgggcaaccttattggcaccggggttgcggcgtgggcatttgaatatatgcctatatttgatgaagagacccgcgacgcctttgtcaaaattggtatggaggtcatgaaaaatagcccaacggagatgtttgccaacgcgattatctctggctggatcatcgccacaatggtatggatgtttcctgcagcaggcggggcaaaaattgtggtcattattttgatgacctggcttatcgcgctgggcgataccacccatattgtcgtcggttccgttgaaattttgtatttggttttcaacggcacgctgccctggagcgactttctctggcccttcgcccttcccacacttgccggaaatatctgcggcggcacctttattttcgcattaatgagccacgcgcagatccgcaacgatatgagcaataaacgtaaggaagaagcgaggctacgcggcgagcgcctggaacgggagcggaaaaaagcggaaaaacagcgctgagtggcgacggtttaaccagtcaggcggcgctacacttactccggcgaataaaaaacgctatactggcgccgcgttgtccccttagttaaatggatataacgagcccctcctaagggctagttgcaggttcgattcctgcaggggacaccattgatacccaggacattctcttcttgctgcataacctttcgagcggtttccctttcatgttgcttttattgcccctatgcaatatcaccggacatgccatacgttcagcaaaaagtcgtcatcggccggttatgaccgatgacatcccgatgtggtctagaagcgatactgcaaccccgcggtaaccgtatagttattattagctatacctgcggcatcgccaccaaaatacgccgtatcaccgctggttttatctatgatttgcgtaccgcccttaccttcttcatatttactgtaagcaaactcagcaaagatttttgcattactggtaatataatatccggcgtcaatagaagcgccataatatcgtgaattttccgttttttcacggaaggtaagtttgcgcatgtagtgttcgtcattatcatgcgcatttacccagtcgctgtatttaaacagtacattacactcaaagtcattaatacgataatcacccgccagcccgatatagggcatttcgaaacgctggctataacctatgccgcgcacgccatgaggaaaattaccaatatatcgaccattatcataaatataagacccgcctcttgccgtccagctaaaacgggtttcctgatagcccgctgttacgcccgccttgtagttatcgccctgcaataaccaacctttcacgttcaaatcgtattcattagcatagttgacgctggtgtccggatgaattgaacgatcggtccagcctggctgctcactgctcatccagtcatggtcaaccatatgacccgatcccgacgccaaagacgtccagccgcgggcgtccagcgtcatgaacgaatagggttcccatgataaatccccctgcaacgtggcgacattttttattttccaatccagttgactcagcttccgcccggtgtcggtatcataaaccagctccctggatttaccatttaacacacccacggaaagggatgtcgtgacgctatcaggagagacgtccggaataaataaggcagactccgcataaaccgactcagaaaatacggcgatcatcattactgcaatagcatgttttttcatttctcttgtcctcatattcagatgtaatctggagaggtgatgaagttttcatcttgtcaaatcgtcggacaagagtacatttattacgccagagaacttgacgcatttttaccttatattgaagttaagaaatagaatttgatgctcaggtgaataataagcaatctataatcatgatggaatgatttaccattacggtgatgcgacgttatctggctaacgacatcgttgctgatgttgtcagccagattgaaagtaactgtaatatcagaatttataatgctctttacttagaccatattttttcatgcgcagataaagttttttacggggaatttgcaggtactccgccacttcattaattcgtccctgatgaatatttaatgcttcggtaatgatttgtcgctcatactcttcaacgcgccggtcaagcggggtcggctcctgaagaagcaactgcgggttgaccgtttccgccagcggcagcacgccaacagcaaaaagctctgccgcattagccagttcgcgcacattgcttggccaggcgcgtcgcattattcctttcagtaattcccccgctatttccggcactggatgattgagtcgcaggcaggcttttcgaagataatggcgaaataacggctcgatatcatccggtcgctgagaaagagactggcaggcgatttgggtcatggcgaaacagtagtaaagctcggctgcaatctggttagctgccgcctgctccaccagcgaagcgctgccaacgcccaccaaacgaaaaggccgatgctccaggctttgtaaacgcgccagatggtgctgctgttcgcgtgtcagatattcgggatgactcaacaccagcgtgcctccttgcgcctggtcgatgaatgtctccaactgcccggcattctccggcgtaagttcatagcgtacaaacggccctttcgcgttacgccccagttgatggagataacgggcgccagtcatacgtccagtgccatgctcaccgtaaaaccatacggcaatgtccgtttccgccagttgttgtaaccgttgtcgaaactgattcatccactcgctgcgcccaatcagttcaacctgtaacgtctgctggcaatattgccgccgtgcaatgaccgaccggcgctggcgtagcgcgtcttcaattaatatcaacagcttgcccggatcgacgggtttttgcagaaaatcccaggcgccctttttcaccgcatcaaccgccatcggtacatcgccatgtccggtaatcaataagattggcagttgatcgtcatcctgatgaaacagcgtcatcagatcgataccggaacaccccggcatacacacatcgctcaaaacgatcccctcccaatccgcttttacccactctttggcctcgaaaggatgggtaaagccacgcacgcggtagcctgcctgctcaagcatttgggtataggcgtcaagtacatcaacgtcatcatcaatcagcaaaatagaacattcatcattcaacatcatcgacatccgttaccgagaattgcagcaccacgcaagcgttacgcgtcagcgtcgacgccagacgcaggtcgcccttcatttgcgccatcagcgacacgctaatcgacagcccaatacccaacccgacagctttactggtggtaaacggcttgagtaaagagggcaacagcgccacaggccagccagggccgttatctgcaatataaacctccagcgcctctccctgcgtctgccacgtcaccgcgatcaccgcatcatgcgaacaggcgtcaagcgcattcgccagcacattcaccagaacctgctgaatacgcacttcatcgccgctaacccatacggtgtcggttggcagtgaaagcgctccctgccgggattggtggcgcatggctaataactcccatgccgccacaaaggtttggcgcagatcaacgggatacaatggcgtttccagctccgcccgacgggtaaactgccgcagcgaacggataatggcgtcaatccggttaatgagcccttccgctttggtgagcgtatttctcgcctgtccgctctgaccttgttcaatcgcgcgtcccgccgtaaataaatacattgaaagcgcattcagcggctggttaatttcatgcgccagcgtggtcatggtctggccgactaccgccagtttcgccgtctgaatcaactcatcctgcatggcgcgcaggtcggcttctatctctttgcgctcggcgacctcttgttcaagctgcctgcgttgcatattgagctggcccagcgtatgacgtagcaaacgggctatccgtcctagctcatcgcgcccgtaaaccgggatagtcgagtcggttctccccagccctatctgtaccacagcctgattaagcgcggtaaaacgcttcaccagtcgggaacggataaaatagtggttgagtccccaggccagtagcaacgccaggagcgtcgccactaaaataagcccgccgctaacgcgaacaatctgttccaggcgttgattgaacgtctgcatttgctggtgactactacctaactgcgcctcaagcagcgtgcgaaagcgccctagcgtagcctctctggcgcggctggcgtccagtaaggctttttgcgccgcaacataatcgcgcatggtatcgggcatcttattttttaccatcccgatttccaatagttcgtcgatggtttgccgtagcgtgatcgtactgggccagtcatccagcgcacgaatattctcatccgccgttttttttaggttttccagatagcgaatatgggtctccaccagcatcccgtcattattgccggacttgagctcattcaatctgtcgcgcaggtcgtcaacaatctgattttcaattcgcgccagggtatatacctgctgctgctcgttctgcacctcgcgcgaacgttgcaaatactgcgctgcatcgccctgattcgcctcaatttgatcgagcagcgtcccctgctgccaggtaaaatcctgtaccagcgaatttagctccgtggtgaaatcatcatggagccagtcaatgcgagcggaaagctcgctaactttctcccgcaccaaaaacatgttgtagagggcattgtccagctccgccagcaaggtccggctatcctgtaaaatgacggccagttgccggcgctcagcaagctgaagcccctgactgagacgctcaatcttatccagatgctgaataatctgcgtacgtaactgcaaacgtaccgtcgtgttcggcgccagcaaaaattcattgagttgatccacggccagattcaggttcccctcaattaaaaaagcggagtggatgcgaggaaaatattcatcaagcgaatagcgaacctgcgaactttgctcatgccaggaataaaggctgaccatactgacaatcagcgtcagtaatgcgcccgttaaaaatgcgccccgtaaactgttgctgatactgagctgacgaagccgttgcaataatctccccttcatttcagctcttccagtttgtgaatcgccagccgctgattgttcagaaaccagatctgccactccatcattttttgttcggcaaagcttttattatcaaactgcgccagccaggtttcatcttcgctgcttgccgcatccaccgggacgctggtcaataaggctctgatttcaggtaaggggcgtttaagccgcgtttctgcgctgtgcaacgctcgccatgcatctttaagctgcgcgagacgaaaactgatcgcggtatcaaacatgcgttgtaccagttgctgacgcttcaggatcagacgatagttcaacggcggctgggccatcaaacgctgttgttgcgcggcgcgaggattatcggcgctaagcggtgcgacgggatacttaccggtattcgcgtcagccagtatcctttgccctttcggacttaataagtaatgaataaaagcacgcgcttcgtctgcatgacggctgtttttcaacaccgcgacgtaagtgggcgacaccgcagaatacgggaaataggtaaaagcaagattaggatcgttaagtagcaaattagcatagttatcaatgaccggcccggcaacgccaagcccgcttttgattttatccgctacgccgaaactgcgagaggaaatcgtgaccagattacccgagattgccagcagcgttgcccatcctgccgtccagcctttttgctgcaacagcgactccaccatcaaatgattcgtgtctgagcgtgacggactgctcattaatagagcgccctggtaactgggcaggcccatatcctgccagtcggcaggcggcggaagatggcgcgcagcgagcgctgaacggttgatcaatagcccaaatccggataccgctaccgccactgaagttgagcggatagaacgcggcaccagcttctggctggcggcaggcgcgctatccaatagcgccagcttttggtgctcctgaaggtgttgcaacagcatgggggatgacgtcaggatcagatcgacattttccgcattcgccgtatcaagtaattgctctaaagaaccgctggtacggttgagcgtacgaatcatgacggaacccggctccgtctgccagcgctggataatccaggcggtcgcgctgggtgaaaaggtcgttgccatcaccagctcgcggctgtacgcctggcaagaaccgaacattgccgccagccatagcgtaaaagcgcccactctggcgaaacgactacagcatgagaaaagtcgatttgtgatcccgttcataaatatcgatatcacataaagaaaatattgagacaaaacttacccttttatttctgttggcatccagaacaacgttatttgaataataacgggtccgtcgcccgaaaacatcaataaagcgtatcagatcactggcagcaaatttgttaatatccgcacatgctaacgataaaacggccatgccaataattaaagtttcaccacacccttcaggatgggtcaaaaataacctttaaattcacccaattgagtcaattttgacacatttcttcgacttgaattttattgtcactcctttcactctaccgacaaaacctcctgatgttcatctcactataaaatacaggtgactccatgttaacaatattaaaaacagggcaatcggcgcataaagtcccaccggaaaaagtccaggccacatatggtcgatatcgtatacaggcattgttaagtgtatttctgggatatctcgcttactatatagtcagaaacaacttcacattatcgacgccttatttaaaagagcaattggatctcagcgctacgcaaatcggcctgctgagtagctgtatgcttattgcttacggaatcagtaaaggcgtaatgagcagtctggcggataaagccagcccaaaagtcttcatggcgtgcggtctggtactctgcgcgattgttaacgttgggctgggattcagtagcgcattctggatatttgccgctctggtggtcttcaatggcctttttcagggcatgggcgtcggcccctcgtttattactattgcaaactggttccctcgtcgggagcgcggacgcgtaggcgccttctggaatatctcgcataacgttggcggcgggatcgtcgcgcctatcgtcggtgcggcttttgcgatattgggcagcgaacactggcaaagcgccagttatatcgttccggcctgcgtcgccgtcatttttgccttaattgttctggtcttgggaaaaggttcgccgcgcaaagaaggtcttccctccctggaacagatgatgccggaagaaaaagtcgtactgaaaacgaagaatacggcaaaagcgccggaaaatatgagcgcatggcaaatcttctgtacttatgtgctgcgcaataaaaatgcctggtatatttcgctggtggatgtcttcgtctatatggtgcggtttggcatgattagctggttgcctatctatctgttgacagtaaaacacttttcaaaagaacagatgagcgtcgcgtttctctttttcgagtgggcggcgattccctccacgctactggcaggctggctgtcagataaactgtttaagggccgcagaatgccgttagccatgatttgcatggcgctgatttttgtctgtctgatcggatactggaaaagtgaatctttgctgatggtaacgattttcgccgccattgtaggttgtctgatttacgtcccgcagttcctcgcgtccgtacagacaatggaaatagtccccagctttgccgtaggttccgccgtcggtttacgtgggttcatgagctatattttcggcgcctcgttgggcaccagcctgtttggtgtaatggtggataaacttggctggtacggcggattttatcttctgatgggcggcatcgtgtgctgcattctattctgttacctctcccatcgcggcgcgctggaactggaacgccagcgccagaatgcgttacataatcaggactcactgcagcttgcggacgcgcaataaacgattagccttcctggggaacagaagcgccgacattgtcggcgctatctattcactggcatcgtatatacccaaaataattcgagttgcttaaaggcggcaagggagtgagtccccaggagcatagataacgatgtgactggggtgagcgacaaatctgccgggagcagatttgaacgtcacgtgcgacggcccgtcagagcgaggcccatcgatgggccgagtaatccgtagccaacacatcagcaacttgaagtatgaagggtatgtactgactaacgcttaccgtatcccaccataaagcgaataattaacccacatgccggtgcgagaaaaagcaataatccgctaacgatgtcatcgccatcctgcaaccatacattgagtaaataaatcagcgcggcaaggataaccattcccgtaaaagaagaaaccgcagaaaaagcccccatcacctgaccgatatagccactcacggcaagtatacttattgcaagaaatgtccataaatagatcatctataatacctcctgtctatggcaaggcttccatatagccttacggtccctctcacttctcctttaagataaaccttatcagcccgtcatttccataacatttatctcacattttatttttttaatcatttttcaatgaccttcgtctgaaataaaattatcactgtaaaaacaatgcattaaaaataatgattagcttatttttgctacgggagaaatatttacgcttcttgataaagaatttctgggcgcgagtaaataactggtggtacattagcctgcctggcgttcatgccctcgtggtttagtactgacttagttttacactccttacgggaaccattgtcgtacatgatggcctaactatacgtaaatcattcaagttaccctgatgagcttactcaagtaagtgcttcggataagcgaacgcaacttgaaggatgatgcgtatttcagagtgtaccgctgcggataatgactcttctgcgatacattattttcgtatctacagaaggtattttatgtttcctcaaagcaaattttcacgcgcgtttttgcacccgcgctactggctgacgtggtttggcgttggcatcctctggttactggtgcagcttccctacccggttttgcgttttctgggcacccgcaccggtaaactggcgcgccccttcctgaagcgacgtgagtcaatcgcccagaaaaatattgaactctgttttccgaccctctcccgggaagaaagggaaaaactgatcgccgagaatttccactctcttggcatggcgctgcttgaaacgggcatggcctggttctggcctgatagccgggttcgcaaatggtttgatgtggacgggctggacaaccttacccgtgcgcaggcgcaaaatcgcggcgtaatggtcgttggcgtgcattttatgtcgctggaattgggaggccgggtaatgggtctctgccagccgatgatggcgacctatcgtccgcataacaatccgctcatggagtgggtgcagacgcgcggtcgtatgcgctcaaataaagcgatgatcggcagaaacaatctgcgcggcattgtgggcgcgctaaaaaaaggggaagccgtttggtttgctcccgaccaggactacggccctaaaggcagctcctttgcgccatttttcgcggttgaaaacgtcgccaccaccaacggcacctatgtactgtccaggctgtctggcgccgccatgttgaccgttacaatggtaaggaaatccgataactcgggttatcgtctgtatattacccctgaaatggaaggttacccggcagatgaaaatcaagccgctgcctatatgaataaaattattgagaaagagatcatgcgcgccccggagcaatatctctggatccatcgccgtttcaagactcgcccgttgggggaagcgtcactctacatctgaaaaaggccgcaaggccttttattttggcatttcgcattgtcataatattcatatcgtaaattactcattcctgcttttagcgataagtctcctgtttacaggcgattttttactgtgtcggcggcgtcgctcaatagcgattcatcactgtcagaaattaaactgtcgccgattcccgacacttgtaagttactaaaagtaaataagaaaatgcctcttgtttcacctcatttttaggcgtacattagcgccgtctggagcgatgacgcgcagaattctgaggtgatgcaggcggtcgaaacacgaataattctcaatttcgtattatccggcatcaactctctataatcaggtaagtgtaagttcatttaggcgtacgacaggtacgcggagagatgaaacgtgaaatatttctttatgggcatttcatttatggtcatcgtttgggccggtactttcgccctgatgatttaaaagtacaatgcaaagaaaaacaggagccatggggctcctgtttgcttttctactccgtgctcgcttcaacgggttttggatgtgacggcagcacgccatcggcgcggaacatcgctttaatccctctgacggcctggcgaatgcggtcgcgattctctattaatgcaaagcgtacatgggtgtcgccataatcaccaaagcctatccctggagaaacgcaaaccttcgcctcattcagcagcttcttggcaaactcaagcgatcccatcgccgcatattgctccgggattttcgcccagacgtacattgaggctttcggcatttcaaccatccagcccgcctcatgcagccccttcaccagcacatcgcgacgacgtttatactgctcggcgatatcgcgcacgcactgctgatcgccttccagagcggcgatagccgccacctgaagcggggtaaaggtgccataatcgtgataacttttaatgcgcgccagcgcgctgaccagggttttattgcccaccataaacccaatacgccagcccgccatattatagcttttcgacaatgtgaaaaattcgaccgccacgtcgcgtgcgccgggcacctgcataatggatggcgctttccagccgtcgtacacgatatcggcatacgccagatcgtgcactaccagcacatcataacgtttagccagagcgaccactttttcaaaaaattccagttcgacgcactgggccgtagggttagatggaaaacccaaaatcatcattttcggtttcggataactttcgcgaatagcgcgctccagctcgttgaagaaatccaccccctcgaccaatggaaccgaacgcacctgcgccccggcgataacggcgccatagatatgaatcgggtaactggggttcggcaccagaaccgtatcgccatgatccagcgtcgccagcattaaatgcgccagtccctctttggaaccgatggtcacaatcgcttcggtttccggatcgatatcgacatcataacgttcctgataccagtgagaaatcgcgcggcgtaaacgcggtatgccgcgagacgtggaataaccgtgcgtatccggacgctgcgcgacggtgcaaagtttttcaacaatgtggggaggggttgcgccatcaggattacccatactgaaatcaataatatcttcaccgcgccgacgcgcagccattttgagttcagcggtgatgttaaaaacatagggcggaaggcgatcgatacgcgtaaagcgacgttcagggcggaagtcagccataatatcctcagattaacgttagcgcccggaccgtccgagcgacgctgccacgatggtggctcctttagaaaatagcctgaaaattttcttcctgtcgagaggctaatgaaaatatttttagcgacaaaaaagaggaacaagcgtaaaaacttactttttaagcgtgtcagttatagcatcaaacaaatcatattattaacaaattgatatcattgaatttacgtaacgtgacgcagccgacgataatttcctgtcaataaaccttatctcaaataatccccttttgattttgtggtttttcctctttaatcaaaagccttactaacgataatggtattcgatcatgtcatattgcggtgtttttcagggatatttccccgaaaatgaggatcctttccggcaagctgccgcgatgaaaccgtaaataaggcagcgaaccggatacgtatagtaaaataaatccctgttttcgcctgactaaccgccatgacgtgatgactcaacgcgctggtgtttgacctttcgctcagcaagagtaaagtgaaataattcagacagttgaagcattcatgcacaggaaaggcaatgaaaaaaaccgcgtgaggcacgcggtttgagactgacaagagaatgtttaattgcctgataacgctgcgcttatcaggcctacagatgacacacttttgtaggccggataaggcgtttatgccaccatctggcttatagaatatgacctaatgtctggcgcagatgcgcgccggaacctaacaagccaggattatcatggacaatcagatagaccggaataccgtgtacataatctttaaagcggcctttatcttcaaagccaccacggaagccggacgctttaaaaaattccaggaagcgcgggacaataccgccagcgatataaacgccgccaaatgtccccatggttaacgccagatcgccgccaaatcgccccatgatgacgcaaaagagcgacaacgcgcggcgacaatcgatacagctatccgccagggcgcgttcggtaatatctttcgggcgcagattttccggcagacggttgtcggacttaacaatcgcccggtaaagattcaccagccccgggccagacagcacgcgctcggcggaaacgtggccaatttcggcgcgcaatatttccagaatcatagcttcttcttcgctattaggcgcaaaatcgacatgcccgccttcgcccggaaggctaatccaacgcttatccacatgcaccagatgcgccacgcccaagccggttcccgcgccatacaccgcaataggtttgccgtctaccggttcgccgccgccgaactgaattaaatgctcttttttcagcatcgggatcgccatcgacacggcggtgaaatcgttgatgatttccagatggctaaagccgagattttttttcatttccgcaatagaaaaagcccaggtatggttagtcatcgctacccagtcaccggtaatcgggcaggctatggcgatacaaccatcttccacgctgacgctatgctcatcgagataaacgcgcaccacggcctcaagactgggataatccaggccggaatacgttttggcctgcgagatttctccactggcgatatcacacagggcaagacgcgcattcgtgccgcctacatctcctactaaagcatactttgtcattcttctactgctccgctaaagtcaaaataagtctttgtcacactgtaaattcatgggggcataacaacaacggccatcaggctgactgcctataaatatagatcttcatcacagaattactttcttgtttcagcaccaattgcagcaatgccgtcgggcaggctgtgcaaaataggtatacgaccccgtgtaaggaagagattatgttccacccgcgtgcccgaacgatgctgctgctgtcgctccccgcgctgattattggcgtagcgtcaagcctggttttaatcgctgcgatgaaagtcgcgtcggtttttcagcaatttctttggcaacgactgcccaccagcatcggcatcgcttatgattcgccgttctggatagtgggtatgctcacgctaaccgggatcgtggtgggtttgattatccgttacagtcccggacacgctggccccgatccggccatcgaaccgttaatcagtatgccggtctcgccatctgcgctacccgggctgcttctcgccttaatcatcggccttgctggtggggtaagtttggggccagagcatccgataatgacaataaatatcgcgctggcggcggctttcggctcccgcctgtttccgcgtatcacggcgttagactggacgattctggcctcagcgggcaccatcggcgcgctgttcggcacgcccgtcgccgcagcgctgattttttcgcaaacacttagcggctctaacgatattcccatgtgggatcgcctgtttgcgccgttaatggcggcagcggcggggtcactcaccaccagtctgttctttcatccgcatttttcgttacccatcgcccattacacgcagatgcggctggtggacattgccagcggagcgatcgtcgcggcgatcgccattgccgccgggatggtcgccgtctggtgccttccgcgtctgcatgagttgctgcaccgcctgaaaaatccggtcctgattctcggcattggcggttttatactgggtattctgggcgtcattggcgggccgcttaccctgtttaaaggcctggacgaaatgcaacaaatggcgtttagccagacgctgggcgcgggagattattttaccttagccgtcgtcaaactcgccgcgctggtcatcgcggcggcgagcggctttcgcggcgggcgcatttttccggctgtgtttatcggcgcggcgctggggctcatgctccatgcccatgttgaggccgtacccgcggcgattaccgtctcctgcgcgattcttggcttagtgctggtagtgacgcgcgacggctggctcagtctgtttatggcggcagtcgtcgtaccggataccaatctgctgccgctgctctgcattgtgatgctccccgcctggctattgctggcgggaaaaccgttgctggccgccaaccgtcacgaaccctaatccggcgcagcgggggccattatcccccgttgcgggcttccagcgcccgggtcacggtacgcagtaattccggcagatcggcttttggcaacatcacttcaataaatgacagacgttgtgggcgcgccaaccgttcgaggacctctgccagttggatagcctgcgtcacccgccagcactccgcctgttgcgccgcgtttagcgccggtggtatctgcgtccagttccagctcgcgatgtcgttataccgctgggccgcgccgtgaatggcgcgctctacggtatagccgtcattgttgagcagcaggatgaccggcgcctgcccgtcgcgtaacatcgagcccatctcctgaatcgtgagctgcgccgcgccatcgccgataatcagaatcacccgccgatcgggacaggcggtttgcgcgccaaacgcggcgggcaaggaatagccgatagacccccacagcggctgtaacacaacttccgcgccgtcaggaagcgacagcgcggcagcgccaaaagctgctgtcccctggtcgacaaggataatatctccgggtttgagatactgctgtaaggtttgccagaagctttcctgggtcagttctcctttatcaatccgcactggctgtccggcggaacgcgtcggcggcggcgcaaaagcgcattccaggcacagttcgcgcagcgtagacaccgcctgcgccatcgggaggttgaaccaggtttcgccgatgcgcgacgcgtaaggctgaatctccagcgtgcgttccgccggtaattgttgggtaaatccggccgtaagggtatcgacaaaacgggtgccgacgcagataaccctatcggcgtcctctatggcctgacgcacttctttgctgctggcgccagcgctataggtgccaacgaagttcgggtgctgttcatcaaaaagccccttccccatcagtagtgtcgcatgagcgatgggcgtttccgccatccagcgctgcaacagtggtcgtaaaccaaaacgcccggcaagaaagtcggccaatagcgcaatgcgccgactgttcatcaggcactgacgggcgtgataacgaaaggccgtctccacgccgctttgcgcttcatgcacgggcaacgccagcgcctgcgtaggtgggatggccgtttttttcgccacatcggcgggcaacatgatgtatcctggcctgcgtgcggcaagcatttcacccaacacgcggtcaatctcgaaacaggcgttctgttcatctaatattgcgctggcagcggatatcgcctgactcatgcgataaaaatgacgaaaatcgccgtcaccgagggtatggtgcatcaattcgccacgctgctgcgcagcgctacagggcgcgccgacgatatgcaagaccgggacatattccgcgtaactgcccgcgataccgttaatagcgctaagttctcccacgccaaaggtggtgagtagcgctccagcgcccgacatgcgcgcatagccgtccgcggcataagcggcgttcagctcattggcgcatcccacccaacgcagggtcgggtggtcaatcacatggtcaagaaactgcaagttataatcgcccggtacgccaaaaagatggccaatgccgcatcctgccagtctgtccagcaaatagtcggccacggtataggggttttgcatgacagctttccttctgacgttgatattatgttgagtattaaggaatgccgatggctgtccagcacggtggggatgaaagcctggaaaacaatgtttacagcggcaaacagtaaaagccggataccgcctggcgagtgtaaccgtatacactatttattcacgccacagggggaaaggtcatgatttatcagcccgatgagaatcgttatcacacaatggagtatcgtcgctgcggacgcagcggcgtcaaacttcccgctatttcgctggggttatggcacaacttcggcgatacgacacgggtagaaaatagccgggcgctgctgcaacgcgcgttcgatctgggcattacccactttgatctcgccaataattatgggccgccgccgggctccgcagaatgcaattttggccgcattctgcaggaagattttttaccgtggcgtgatgaattgatcatctccaccaaagcgggctacaccatgtgggatggcccttatggcgactgggggtcacggaaataccttatcgccagcctcgatcaaagcctgaaacgtatggggctggagtatgtcgatatcttttatcaccatcgtcccgatcccgaaacgccgcttaaagagacgatgaaagcgttagatcaccttgtgcgccatggcaaagcgttgtacgtggggatctctaactatcctgccgatctggccagacaagctatcgatattctggaggatctcggcacgccttgcctgattcatcagcctaaatattcgctttttgagcgttgggtagaggacgggctgctggcgctgttgcaggaaaaaggcgtcggtagtattgccttctcgccgctggcgggcgggcagctcactgaccgttatttgaatggtattccggaagattcccgcgcggcgagcggaagccgtttccttaaaccagaacagattaccgccgacaaactggaaaaagttcgccggttgaatgaactggctgcgcgacggggtcaaaaattgtctcagatggcgctcgcctgggtgctgcgtaacgataacgttacctcggtactgattggcgccagcaaaccgtcgcaaatcgaagacgccgtgggaatgctggccaatcgccgtttttcagcggcggaatgtgcagaaattgacgctattctggagggccggttttagcaaaaaatgctctccttcatgatttaagagttaaggcgatgaaacaaatctttactgctttgtaatattgcattaacaggccggcgacggctcgatcgtgaaggagagaaagtatgttcaggtcactgattctggcggcagccttgctggcttttacaccgcttgccgcgaatgcgggcgaaatcaccctgttgccctcaataaaattacagattggcgatcgcgatgattacggtaactactgggacggtggtcgctggcgcgaccgggattactggcacaaccattatgaatggcgtaaaaatcgctggtggcgccatgacaacggctatcatcgcggctgggataagcgtaaagcgtatgaacgcggttatcgggaaggctggcgcgatcgcgacgatcatcgcgggcgaggccggggtcacaaacatcatcactaagcctcctgctgaataacagcccgatgacgcccacgcatcgggcctgctatctttctgtctttatgacaaccccatcaccgttccaaccagcaaccagatattcagggcgacgaccagcacgacaattatccagccaacctgttttacccgccgcgtgttcaccagctcgcccattagcgtagcgttactggtgaaaatcaggagcggcaccagcgccagcgcaataccaaaactcagcagcacctggctcatcaccagaattcgggtagggtccagccccatcaaaatcacaataaatgagggcagcatggtaatggtgcgccgtacccacagcggaatgtgaaaacggacaaacccttgcatcaccacctgccccgccagagtccctaccacagtggaggaaagccctgcagctaccagactaagaccaaacaccgttgccgccgcatggcttagtaacggttccagcgtcaggtatgcctgatcgaggtcggcgatgccggtgtggccgctaaaatgaaacgccgccgcggcggtcgccatcattgccagattgacaaaaccggcaatcgtcatagcaatagcgacatcccatttcgttgctgagtaccgttgttgccgtgttccgccgtgcagatgctgcgttaatgacgagtgcagataaatcacgtgcggcataatcgtcgcgccaagcacgccggcggctaagaatacggcttccgggttcggtagcgccgggataaccattcctttgccgagctgcgccatatcaggctgagagaaaaacagctccacaatgtaagcggcggcgacaaaaagcagtaaaccgccgatgactttttcaagcggtttttgaccgcggcgctgtaacattaaaatcagaaacgtcgcgataccggtcaataccgcgccctgtaataaagagacgcccaggatcagcttaaaacctattgccgcgccgataaattcagctaaatcggtggccatcgcgatgatttccgcctgtacccagtaaaaccagactaccggacgcggataatggtcgcgaatttgctccgccaggttcttgccggtggcgatcccgagttttgccgagaggatttgaatcagcatcgccatcaggttcgcccagaccaccacccagagtagctgatagccaaagctggcgccggcctgaatattggtcgcgaagttaccaggatcgatataaccaatcgcggcaatgaacgcaggtcccattaatgcgagccttagcttgcgcgccgcccgtccgctgctattctctacgcgattgtcagtcatcttttgcctcaaaaacatagcctttgctatgtttcatgctatgtttattgataatgattatcaagtgcatttcaatgggtacgggtgattactttgatagtgtgaaacgatagaccgatacgatgacgacctgtatcagaacagtttggcttaacattacaagattagcacactgatataacttttcattttcatattcagtacagtaaaagtgtattacagatcactaattttgaatctcgtcacaggtccttattatagtgtgtgttggatctcgttttctttacggctgttgcatagaatgtgcacgaaaattaaacctgcctcatatttggagcaaatatggaccgcgtccttcattttgtcctggcgcttgccgttgttgcggtactcgcactgctggttagcagcgaccgtaaaaaaattcgcattcgttacgtcattcagttacttgttatcgaagtattactggcctggttcttcctgaactcggatgttggccttggcttcgtaaaaggtttctccgagatgtttgaaaaactgctcggatttgccaacgaagggacaaacttcgtctttggcagtatgaacgatcaaggtttggcgttcttcttcctgaaagtattgtgcccgatcgtctttatttccgcgttgatcggtattcttcagcatatccgcgttctgccagtggtcatccgcgctattggttttctgttgtccaaagtaaacggtatgggcaaactggagtcttttaacgccgtcagctcgctgatcctcggccagtctgagaactttatcgcttataaagatatcctcggcaaaatgtcccgtaaccgcatgtacaccatggcggcgaccgcaatgtctaccgtttccatgtctatcgtgggcgcgtatatgaccatgctggaccctaaatatgtggtcgcagcgctggttctgaacatgttcagcacctttatcgttctgtcgctgatcaacccctatgtcgttgatgccagcgaagaaaatattcagatgtcgaacctgcatgaaggccaaagtttcttcgaaatgctgggcgagtacattctggcaggttttaaagtggcgattatcgtcgcggcgatgctgatcggcttcatcgcgctgatcgcggcgctgaacgcgctgttcgcaacggttaccggttggttcggctacagcatctccttccagggcattctgggttacatcttctacccggtcgcatgggtaatgggcgtaccgtccagtgaagcgctgcaggtaggaagtatcatggcgaccaaactggtttccaacgaattcgtggcgatgatggatctgcagaaaatcgcctctaccctctctccacgcgctgaaggcattatctccgtcttcctggtgtccttcgcgaacttctcttccatcggtattattgcgggcgcgattaaaggcctgaacgaagagcaaggcaacgtggtttcccgttttggtctgaaactggtttacggttctacgctggtgagcgtactgtccgcctctatcgcggcgctggtactgtaagtctgggtttaatgcagaaaccggggagctatccccggtttttttatgccgcttatttgcctaacgggcgcgggcggccaatcagatatccctgcaaactgtgtacgccaagctgcaatagcagatcgcgctgcgcaggcgtttcaacaaactcagccacgacgctcaacgatttcgctttcgctaaatcagtgatggatttcacaatcatcgcatccagggagtccgtcagaatatcttttacaaaacaaccgtcgattttaatgatgtccgccttgaggcgttttagccgttcatagtttgcataaccggtgccgaaatcatcaatggcgatttttaggccgaacttacgcagttgattgatattgtgcatactgatttcggaatgagagaaggcctgttcttcagtaatttcgatgatgaccgaagcaggcgggacgccatagcgtttaaaaagctgcataatgcgcgacgccgtctctttttgcagcagcgtcaacggcatcaaattaaccgaaaaacgtgccccctgttccgctgaaggatgcgcggacagccattgcaggagcgcttccatcacctgcatatcaaaccgtatgctcaggttaaactgggcgataagcggaatgaactgattcggcatcatgataccgtcgtcgcaccgaagccgcgtcagaatctcgtcatacccttttccctgcgcgtcgcgaatgggttgcgcatacaaaaccagcgcgccgcgctccagcgcctgacggattttctgcaaccgcagcacccgttccgtcgtctgcccggaagcggcttcaatactctgggtcagtgcaagcacccgacggtgcgaacaggattgctccgccagccagcttaattgccccaacagcggttgcaaggtttcctggcgaccatcgaatgttccccacgatgcgccgtattccatgtccagaccggtattgttccagtaaattttgcggttattaagcacgttgagcatatattgcaggcgggcttccgtctccggtcctgtcagcaccagcaataattcactgcccggcagatggaaaattttctccttttccagcagcagcggctgcaacatgcgaaacacctcgcgttcgcaatgcacgcgcatctgcataccgtaatgacggctcagaaattccaggttttccatgcgtaaataacacacgctttgcccggcatcctgtaaaagaaactgctccagcgcacgcaggttaggcagttgcgtcaacggatcggtcaatgcctgcgagtgccattgtcgattcaaccattcgctacgctgattaatccgcgccatgtacaacaaacaaatactaaaagaaatgagaactgaaaggataaatgccagcgaatattctgaacccacgccctgcagaaaattgcggttatagctaagcaggaatagcgcagtgagagcccaactaaaattcaacagcggatagctgattttccccacgccgatggtaaatccaatgaacagaactggcaccagatagccagcaatatactttgtctcgaaaggcgtacacagcaccgctaatagcgtcgccagagtggcaaaccagagaagcgtaaacaggcgtttttctttggcgagataaggagcgacatccctccgccagaaaatacgcatatagtgcgggctgactatcatccgcagcggataatagaaaaagagggtaaaaataagcgcggcagaaatcagactcaataaatcgacaatcgagaaaatagcggtgccggtgccaaagaaggtagagatggtcaccgggaaagccaggtagtgccccgccagatgcatactgatttttataccaaacggcgtcattaaccctaaccagaaaacgcgtagccagatgccttggttgggtattccgtagcgccagcgcgcgcccagctgccagcgtacgatagcgcaaaccagcagcacgggaaacgtttggcaaaatagcagcaccatcgcctgtggcagaggtaaatgaaaattccattcattagtcaacatcattccgcctaccatcggcgcgacgccacggcggccaaataaaaacagcacggaaaacatgacgcagagcggtagccaggccagaaagatatagctggaatcaattgtggcgcggggagaaatgagacgagatagcagaatagccggaacggtcaggcagaaggccagtaagaatatttttatattttttaatacgttacacttatccggcattgctttaatgctcacatcattatataaggcgcatgaataataagtatattcgcattatgaagcaatctaacaaaagctcatattgaccgcaaaagcagcggcaaacaaacgcacctgaagagcagatcagaggccataaattttgtgacaaaaagcaaaaacccccgcttttcagcgagggtttgaatgttggtggagctaagcgggatcgaaccgctgacctcttgcatgccatgcaagcgctctcccagctgagctatagccccatagtgcttttacgtatacgccaaatttatcgggagtaaatttggtggagctaagcgggatcgaaccgctgacctcttgcatgccatgcaagcgctctcccagctgagctatagccccactacgtaaagcttgtcgagttgacgggcggcatcatatgaattccctcggcatgtgtcaacggcaaaatgaacttgccgaattcaatcgctgaaaaagcattcaaataaaggacattgcggcacaactcgcattcagtagttaaacacgtcacggtttcgactaaaatggtgctataaaatgaaccactaattaaccccacgactattcagggaatcgttatgttcaaggaacggatgacgccagaagaactcgctaatctcaccggttacagccgacaaaccatcaataaatgggtacggaaagaaggctgggcaacatcgcccaaacctggcgtccagggcggtaaagcccgtctggttcatgtaaacgaacaggttcgtgaatatatccgcagcgctgaacgttcagttgaccatcacgcagacacattcacgcctgccagcaacgcatcgcttgaagcgctgctcatgacgctcgccaaagagatgacctcatccgagcagaaacagtttacctctctcctcgtgcgtgaagggattaccggtttgttacaacgcttagggatacgcgatagcaaataatatgaaaagattacgcagtaaaatgaccactgaagagctggctgaatgcctcggcgtggccagacaaaccgtcaatcgctggatcagagaacaacactggaaaaccgaaaaatttcccggcgtcaaaggcggacgcgcaagactcatccatattgatgccagcgtgcgggagtttattctcaatattccggcttttcgcaaactgcctgcgttttatcaggcggaagaggctttcgcagaatatgcgaacgcggcgcacagtcatgcttatcgacaaattattgatgccgttgaaaatatgtctgctcaggaacaggaaaaactggcgctgtttttatcgcgggaaggtattcgcggatttctgacgcgtttaggtatcaatgaggcggactaacaaataataaacggcaggcgtctgccctgccgtttattctgtttcagctggcgttactgctgactttcacgctcggcgataaagcccagcgctttgttgatgcgctcaatgctgcgggttttaccaatcgcatgtacggtgacatccagcgcaggcgactgcccggcaccggtcacagccacacgcagcggcatccccactttacccatccccacttccagctcatccgccgtggcctgaatcgcgtggtggacgttttctgctgaccagtccgtaatcgccgacagcttgtcgcgcaccacttccagcggctgacgcgccaccgggcggaggtgttttttcgccgcatcggcgtcaaactcgctgaagtcttcatagaagtagcggcagctctgcgccatctctttcagagttttgcagcgctcgcccagcaacttcaccagttcagcaagctgcgggccgttacgggtgtcgatattttcctgctcgatatgccactgcaaatgcgtcgccacatattccggcgccagcgtattgatatagtggtggttcagccacagcagtttatcggtgttgaacgcgctcgcagacttgctcaccgcaccgagggagaacagcttgatcatctcttcgcgagtgaagatttcctgatcgccgctggaccagcccagacgcaccagatagttcagcaacgcttccggcagataaccgtcatcgcgatactgcatcacgctcaccgcaccgtgacgtttagacagctttttaccgtcgtcgccgttaatcatcgacacatgcgcgtacatcggcaccggcgcgtttaacgctttcagaatgttaatctggcgcggagtattgttgatatggtcttcgccacgaatcacatgggtaatttccatatcccagtcgtccaccaccacacagaagttgtaggttggggaaccgtcggtacgacgaatgatcagatcgtccagctcctgattgctgaattcgatcgggccacggatctgatcatcaaaaataacggaaccgtcctgcgggttggcaaagcgcaccacgcatggctcatcgtcggcatgatgttcgtgactgtgacggcaacgcccgtcataacgcggcttctcgcctttcgccatctgatcttcacgcagttgctccagacgctctttagagcagtagcatttataggctgttcccgcctccagcatctcgtcaatcaccgcgttatagcgatcaaaacgtttggtctggaaatatgggccttcgtcccattccaggttcagccagttcataccatccatgatggcttcaatggcttccggcgtggaacgctcaagatcggtgtcttcaatacgcagcacgaactcaccgccgtggtgacgtgcgaaaagccaggaataaagagcagtacgcgcgccgccgacgtgcagataacctgtcgggctaggcgcgaagcgagttttgattttcatgaaatggccttacgtttataaagatgccgacaaccggcaaatcctggaaagatgaatagccttgtattctatcactgtggcttgattcctcaatgttgatccggtcagaacgctgcgctttgctatttccgtatagaaatcatgcagtgcggggtaattcacgatcgttttgtttaattttacgacgaacaaacaaaaactttagaaaatgcgttgactcattttcaactctccctataatgcgactccacacagcgggggtgattagctcagctgggagagcacctcccttacaaggagggggtcggcggttcgatcccgtcatcacccaccaactactttatgtagtctccgccgtgtagataagaaattgagaagtgggtgattagctcagctgggagagcacctcccttacaaggagggggtcggcggttcgatcccgtcatcacccaccactttctcgccagctaaatttcttattgtgaagtaccgaagtgggtgattagctcagctgggagagcacctcccttacaaggagggggtcggcggttcgatcccgtcatcacccaccacttcgggtcgttagctcagttggtagagcagttgacttttaatcaattggtcgcaggttcgaatcctgcacgacccaccaatgtaaaaaagcgccctaaaggcgcttttttgctatctgcgatatggaagattcgaacctgtcgcaggttcgggtcttgcctgatgcgctgcgcttatcaggcctacagacgacaccgcacacgtaggccggataagacgttagtcgccatccggcacagacattataccgtcaacgccgccaccagtttctccagtgctggcgttgcctgctgctggtcatacacaatatacaaatccgccggaatacgttcctctaacggacggaacaccacacccggccagctcatttgcgcatagccatcagccatcaacgtaatcccgatccccatactgatcatcgccaacaccgtttgcggctcaaccacttcccgaataatcattggcgaaaagcctgcctgttggcatacacgttgtaaaaatccccaatcagaatgtacggaaggcaacgtaacaaaatattcattgcgcaacgccgccaacggcacagaatctctggatgccagatcgtgatcttccggaactgcaaccatgaatgcagattcatgcaaacgtatgctggtaaaaccgactgctggttcgatagccatacgccagatccctgcatcaagttcccgacgctctaacaacgccatttgcataccgggagacttttcgcgaaaaagtacttcaacattgggatttgctttcaaaaagtgacgcatcgcaggacgcattcttccccacagcgccgtaccaaccacacccagttcaatgcgccccgcttcaccgcgaccaatctgctccactcgcgccagcgcctgatttgcactggctaacaagcgacgtgactcctccattaaaactttcccggcatgggttaatgcaacgctgcgggaatgacgaataaacagcaatgtacccagttgctgttcaagttctttgatatggatactcaagggaggttgtgacatatttaaccgggcagcagcccggccaaaatgcaattcttctgcaacagcgaggaaataacgtaatagctttagatcaatacgatgggctcgttccatcactatcgcactccaggaataagggataacgtctggaatttaccatattacctagtaaaaaatagatttaacgacaagatacccaatatacataaatacaatagataataccccgggtaaaacatttggtgcgggaataggtatacggcataaagtaaaaaatgcgccaataccaaatccaataccggaggagagaataatttctttcatgctgtgtccttgttcataaaaatggactggcgaacatcctctcgccagtcaaataaaattaatgtgctaatgatttggtcgacagtttttctggatggtgctgatatttaaagaacaatgcaaaaataacggccaatgccagagcgtaggcggcaaagaccagccagatagtttgccaatcttttacgccatcaatagaaaaataatccacggccataccgcttaaaagagacccaatccacgcccccacgccgttaaccatggtcataaatagcccctgcgcgctggcgcgaatacttgagtccacctcctgctctacaaatactgaccctgagatgttgaagaaatcaaatgcgcagccataaacaatcatcgacagcagcagtagcacaaagccaaacggggatggatcgccaaaggcaaagaagccgaaacgcagcgtccacgccagcatactcatcagcattaccgttttaataccaaagcgtttaaggaagaacggaatggtgaggataaagcccacttccgccatctgcgaaactgaaagcaagatagagggatacttcaccacaaagctgtcggcaaactcaggattacgggcaaaatcatgcaggaacggattaccgaagacattggtaatttgcagcaccgcccccaacatcatcgcaaacaaaaagaagattgccatgcgtggatttttaaacagaacaaaagcatccagtccgagcttactggcaagcgtggtgttcgccttcttctcggctaccggaattttcggtaacgtcagcgcatacagggccagcaataacgatgcgccagaagcgatgtataattgcgcactgctcagttccagccccatcaggctcaccgtccacatcgcaacaataaaacctattgtgccgaaaacgcgcacaggcggaaatgacgttaccggatcctgacctgctttcgccagacaggagtacgaaacgctattggataatgcaattgttggcatatacgccatcgcattcaccaacatcacccagaacatcgtctggggatcggtaacggtggtggcgtacaataacgcccccgcgcaaaccagatggcaaagcatgtaggctcgctcagcgcgcagccatttatcagcaatgatccccataatacccggcatgataatcgctgccagtccttttgagctgtagaccataccgacattcgcgccggtaaaatccagagtgttgatcatgtaagagcccagggtaaccagccagctcccccagataaaatattgcaagaacgacatgacttttaagcgggacgtaatacccattttttattccttgccgtgagataaagccccaatacggggccgtagtcattgtgtttaggccagcttacgtaaaaagccgcaaatcagatttataaagttctgccgggaaagttcagccgccgccagcgtttgcgcatgggagagttttacatcgcccagcccttccgccagattggtgatcgctgagacggcaacaactttgaggccacaatgacgtgcgctaatcacctcagggacaacggacattccgaccacatcgccgccaataatctgcatcatgcggatttctgccgccgtttcgaagttcggacccggataagaaacaaatacgccttcagtgagggtgaatccctcctctgccgcaacggactgaagcatggcgcgataatctgcgtcataagcattagccagcgagaagaagcgatcgccataacgatcatcgtttggccccaccatcggcgtaccgggcatcgtattaatgtgatcgctaagcgcaaccaggctacccggccccacttccggacgcagagatcctgccgcattggtgcagaacaacacttcacagcccagtaatttcaacgtgcgaatggcatcggtcatcaccgccattccacgcccttcataaaaatgtccacggcctttcatacaggccaccggaacccccgccagatggtcgagcaccagttcaccagcatggccgtgtacggtgctgacgggaaatcccggcaatttctcgtaagaaatggctaccgcatcttcgatttggtccgccagagcacccaacccggagcctaaaataaacgcaactcgcggggtaaatgccggtttatgtgcatgaacaatatcaacacaatactcaggattatgagaaaaaagagcgtgaggcataagtttccttgttctatcggatttaatttgactcctttttataacgaccatcgccccttgctgaccaatacacttttcacgtgtcatcaatagccatttaatatcgataaatttagatcgcttctgtattaatacagagggaaaacagtattggtttttgcttgcaattcatattaacaatatgccgctttcatatttataaattgcctctttttaattaacccattaataattatcggcatagggaaatatgctatgaaaaaaattcttactctgacgctttcttctttactcattattcccgcactcacccatgcggaatttaaaggcgggttcgccgatatcggcctccattacctcgactggacatcagacaccacggaaaaaaccagtaaaaaatcccataaagatgattttgggtacctggaactggaaggcggagcgaattttagctggggagaaatgtacgggttcttcgactgggaaaatttttacaatggccgccacgctaaaccaggcagcgaacagcgttacacctttaaaaataccaaccgtatttatctgggcgatacaggattaaacctctatctccatgcctacgggacgtacggttcacctcatcgcgctaatttccatgatgacatgtttctctatggtttaggctataacttcacaggtaacggttactggtttaaacccttctttgccaaacgttataccgatcagacctactacacaggcgataatggttatgtattaggttgggtggccggctatagcttctcgttgggtagtgagaaattcagcgtaacgaactggaatgagtatgagtttgaccgcgatgcgtcctacgctgcgggcaatggcgggaaagatggcattaatggcgcagtagcgctgtggtggaatgcgactcctcacctgaccgcaggagtacaatatcgttacgctgataataagttaggagaatccttcctgcaggatggcattatttactccatcaaatacctgttttaacacacagccctgtcaaaaatggcagggcaagaccgcacctcacacacggacagatagatatttatagctgatacagcggatctttcgccctcgcggcggttaattcgctggcctgggtacgcaccacgtcccacaacgcctgcgccgccgtggagagcgatcggttttttcgccgcgccagcatgagctgcctttcaactacgggcgtcagccgtttaacctgtaagtggctgccctgcgggagcggtaacgccagcgcgggcagcacgctgatgccgattcccgcttccaccattggaaacagcgtggccgggtgaccaatctcctgcacgatatccgcctcaatagcaaaatgggccagcgccgcatcaatcagcggtcgactgccggaagcataatcctgtaagaccagcgaggcctgtttaagatcctgccagctcacccattcctgatgcgccagcggatgatcctggcgacacaacagtaaaaaaggctctgataagatggcttcacactgtaaatccaccgctgcgccgggatcgataacgatgccaaaatccacttcaccctggcggatgctctccagcacccactgctgcggacgatcgtgcaatacaaaatcaatagcgggataaagtgaattactttgggcaatgcattgcggaataagatgcgcagaaatggtttggctcgcggcaacgcgcacggtgccggttaattgtgtccctactctgcctgcatcgcgcagtatgctgttcagttcatcaagcacccgctccagacgcgtcgccagttgttgccccgcctcggtcagcaccacctcacgcgtagtgcgatccaacagtctgacgccggtttgccgctccagctcttttacgctatgactgaccgcagactggctcagtccaatcctgtcccctgcccgactgaaacttttggcctgggcgacggtaataaaaatacgcagttgacgcagtgaatagttcatcgactagattcatatatagatgcaataaatcaattttatttctcaaagcgaaaaacgcaaaatagctgcaccgactttcaggagtttttatgaaactttttcgtatccttgaccctttcacgctgacacttatcaccgtggtactactggcctcttttttcccggcggaaggtggctttgtgcctgtcgttgaaggcattacgacagcggctatcgctctgctgttttttatgcatggcgcgaagctttcgcgtgaagcgatcatcgctggcggcagccactggcggttgcatctgtgggtcatgtgcagcacttttgtgctctttcctgtcctcggcgtactgtttgcctggtgggcgcctgtcaatgtcgaccctatgctctacagcggctttctgtatctgtgtattttgcccgccaccgtgcagtctgcgattgcgtttacttcactcgcgggcggtaacgtcgcggccgcggtgtgctcagcgtctgcgtccagcctgctgggcattttcctgtcgccgctgctggtcggtctggtaatgaatattcatggcgcgcagggcagtctggaagaggtgggcaaaattatgctgcaactgctgctgccttttgtgctgggacacctgtctcgcccgtggatcggcaattgggtcgcgcgcaacaaaaagtggatcgcgaaaacggatcagacctctattctgttggtggtctactcggcgttcagcgaagcggtggtcaacggcatctggcacaaagtcggctggggatcgctgctgtttatcgtcgtggtcagcctcatactgctggcgatcgtcatagccattaacgtctttgtcgcccgtaaatgcggcttcaataaagccgacgaaatcactattgtcttctgcggttcgaaaaaaagcctggccaacgggatcccgatggccaatattctgtttccgacgtcagtgctgggtatgatggtattaccgctgatgatcttccaccagatccaactgatggtctgcgcagggctggcgcggcgctacaaacgccagaccgagaagttacaggcgcagcaggaaagccgcgccgcgaaagcttaaagcgggcgtttcaggggctgtaccagttgcgtcagcccctcggttttaatcagcagcgtgatttgcatcaactcccccagtttacccgccggaaattgatctttacgggcaaaccacagcaaatactcttccggaaggtcgatcaatcgacgtccctgatatttgccaaagggcatcacggtgttggcgatttcaaccagctgctctttttccatctcaggcacccagtaagcggatcatttccgcttcatcaatcacggtaatacccagttcctgcgctttggccagtttggagcccgccgcttcaccggcaatcaccagatcggttttcttcgatacgctgcctgccactttcgcgcccagcgccactaaacgcgctttagcgtcatcgcgagacatctggctcaggctaccggttagtaccacggttttaccggcaaacgggctatcgatctcttgcacattaatgactaccggcgcgggccagtgaaccccttccgccagtagctgcccaatcacgtcacgattactctcttcggcaaaaaagttaaagacgtgcgtagcgaccacaatccccacgtcaggtactttctgcaactcgtcaatggtggcggcctgcagcgcctccagcgtaccgaaataagccgccagccccgccgccgtcgcttcacccacttcacggatgcccagcgcatagagaaaacgcgcaaaggtcgtcgttttggatttttccagcgcgttaacaacattttgcgcggactttggccccattcggtccaggccggtcagtttacccgccgtcagacggaacagatccgctggcgtatggacatactccctttccaccagttggtcgatgatcttatcgcccatcccgtctacatccatcgcccggcgcgacacaaaatgtttcagcgactctttacgctgcgcgccgcaaatcagcccgccggtacaacgggtaacggcttcgccttcaacgcgctctacgtccgatccgcacaccggacagtgcgttggaaacacaatcggacgcgtctcttcagggcgttcggacagaaccacgttgaccacctgagggatcacatcgcctgcccgacggataaccaccttatcgccaatgcgcaagccaagtcgctcaatttcatcggcattatgcaacgtggcattgctgaccagcacaccagccacctgaaccggttccagacgcgccaccggcgtaatcgccccggtacgcccgacctgaaactcaacgtcgcgcacaaaagtcatctgctcctgagcaggaaatttaaacgccaccgcccagcgcggcgcgcgggccacaaagcccagcagttcctgcaaagccagcgagttgaccttaatcaccacgccgtcgatatcaaaaccgagcgtagggcgatctttttcgacgttgtgataaaaatccagtaccgcctggggagaatcgcacagcgtcacgcgatcgctgaccggtaacccccacgctttaaattgcagcaaacgtcccagatgcgtatccggcaactcgccgccttccagaataccgacgccgtagcagaaaaatgttagcggtcgcttcgccgtaatacgcggatcgagctgacgcagcgaacccgccgccgcgttacgcgggttagcaaacactttgccgccagtgcggcgcgcgtcttcattgatcttttcaaacccggcctgcggtaaaaatacctctccgcgaacttcaagacgcgccggaatgttatcgccgtgcagctttaacggaatggcgcgaatcgtgcgcacgtttgaagtgatatcttcaccggtggtgccgtcgccacgcgtcgcagcgctcaccagcacgccgttttcatacagaatgctgaccgccagaccatccagctttagctcgcagcaccagatgacattttccgtgctttttagacgatcctgcactcgcttgttaaacgccaggaagctttcttcatcaaatacgttatcgagcgacagcatcggtacttcatggcgaatctggttgaatgccgtcagcggcgccgcgccaacgcgctgcgtgggcgaatccggcgtgataaggtccggacgttgcgcctccagctctcgcagttcccgcatcaggcggtcatattcggcgtcgggaatctctggcgcatccatcacatgatacagatattcatgatggcgaagcgtggttcgcagttctgtcagttgttgttcgattggttccatatcacaccatcaatgataaaaaacccccgacaggcgggggttacgttaaaaatgtcacacctgcgttaacctcaggcgttagcgtccatcacctcgcggatgcggtcctgatattcgcgcagtttctgcggcgtcatcatccgacgctggtcatccagcacgacgccaccgacctcatcagcgatatgctgcgcggattgcagcatcagcttgaaattctgcagcgcatcgccgtaagacggtacctgcataaagatagtgacgccaggcgtagtgaagtccgtcatttcaggatcgaacgttcccggattgaccatattcgcgagactgaacaaggccgggccgctgccgtccgggctcaaatgacgatggaaaatattcatatcgccaaatttaaagcctgactgctgaatactgttcagtaacacttcaccattaagctcgctgccatgatgggccgcgacgttcataatgatgaccgcctctttacgctgcggtttttccacaaccggcgcttcttccactaccggttccgcctcaaccacaggttccgcaggctggaaggtttgcgctgatggcggcggcgcgggctgcgcaacaggctgcggcgcttgcgacggcggtgcaggctgctgttgcggcggctgtaccggcggcgcagatggctgaacctgctgaggctgcggcgcaggttgaaccggttgctgaaccggctgttgcatcggcgcttgcggctgcggcggcgccgctggacgcggttgcgcagacgcataaggcggctggtactggtgttgcggcgactgacgaggggcatcatgctcctgcgactggccgggggcatgatttacgcggtgaacacgaacttcacccacgccttcgtcttcttcgacatcgtcgtcatacgagtcgtcgtcgcgtttcgatttcatgcgttttagtggacgatcgcggaacatagaagatcgttctttacggctggtccagaaaccatgtaccagtaaagcgattatggcgatcgcgccaacaatgattaatatcagacgcaaatcctgcatcattatattctctgttgttctaacaccttgccaccacggcaaacatttactcactaagagtatttgccgattacgtcaagtgcaagtgtactgttggctttcgcagcataaagatgaaggaaaatgtgctttttgctgttttttcgaacatttccgaactatccaccgtctgataaccgggtaagatatcccacgtttacccagggctttaagaaaaaggagtatgtcctgaatatggtttcatcatccacaaccgtaccacgtagcggcgtctattatttctcgcaaggatggaagttagtcaccctaccgggaatccgccgctttgttattttacctttgctggtcaacattgtgctgatgggcggcgcattttggtggctgtttacccagcttgacgcctggataccttcgttgatgagtcatgtgccggactggctgcaatggctgagctatctgctgtggccgattgcggttatctctgttctgctggtctttggctattttttctctaccctcgccaactggatcgccgcgccgtttaacggccttttagccgaacagcttgaggcgcggttaaccggcgccacgccgccagatacaggcatactcggcatcatgaaagatgtaccgcgcattatgaaacgtgaatggcaaaagctggcgtggtatctgccgcgcgctattgtgctgctgattctctattttattcctggcattggccaaaccatcgcgccggtgctgtggtttttgttcagcgcctggatgctggcgattcagtattgcgactatccgtttgataaccacaaagtgccgtttaaaacgatgcgcgccgcgttgcgcacgcagaaggtggcgaatatgcaatttggcgcgctcaccagcctctttacgatgattccggtgcttaacctgttcattatgcctgtcgccgtctgtggcgcgacggcaatgtgggttgattgctggcgtgctaagcacgcgttatggaaataacgtaaaaatgtataaataagagatggcttatgctgtctcttattccatactgataaccattatttcccatcagcatatagatatgcgaaatccttacttccccatatctggctggaaggtatgctgggaaggtatcccaatttcatacagttaaggacaggccatgagtaagatttatgaagataactcgctgactatcggtcatacgccgctggttcgactgaaccgtatcggtaatggacgcattctggcaaaggtggagtcgcgcaacccgagcttcagcgtcaagtgccgtatcggcgccaacatgatttgggatgccgaaaagcgtggcgtactgaaacctggcgtggaactggtggagccgaccagcggcaacaccggtattgcgctggcgtatgtcgccgccgcgcgcggttacaaactcaccctgaccatgccggaaaccatgagcattgaacgccgcaagctactcaaagcattaggcgcgaatctggtgctgaccgaaggggcgaaagggatgaaaggcgctattcagaaagccgaagaaattgtcgccagcgatccgcaaaaatatctcctgctccagcagttcagcaaccctgccaacccggaaatccatgaaaaaaccaccggcccggaaatctgggaagacaccgatggtcaggtggatgtgtttatctccggcgtcggcactggcggtacgttaaccggcgtcacgcgttatatcaaagggacgaagggtaaaaccgatcttatcaccgttgcggtagaacccactgactccccggttattgcccaggcgctggctggtgaagagatcaaaccaggcccgcataaaattcagggtatcggcgcaggcttcatcccgggcaacctggatctgaaactgattgataaagtggttggcatcaccaatgaagaagctatttctaccgcgcgccgtctgatggaagaggaaggtattctggcaggaatttcttccggcgccgcggttgctgcagcgcttaagctgcaggaagatgaaagctttaccaataagaatattgtggttatcctaccttcatcaggtgagcgttatctgagcaccgcgttgttcgccgatctctttactgagaaagaactgcaacagtgatgccagcatgttaaaaacgcgtaaaaaagcacctttttgggtgcttttttgtggcctgcttcaaactttcacctcacctggcattgattcaccctgccggaactggtatttaaccagactaattattttgatgcgcgaaattaatcgttacaggaaaagcgttagctgaatcgattttatgatttggttcaaatcttcctttcgcggcataatgtttaatgacgagcgaaacgtcagcggccataagttgccagcaacggattgcgtagaacaccttttgtgtcgcgtcccgtttacgccggcgctaacaatacaggctaaagttgagccgccaggctagactttagttccacaacactaaacctataagttggggaaatacaatgttccagcaagaagttaccattaccgctccgaacggtctgcacacccgccctgctgctcagtttgttaaagaagcaaaaggcttcacttctgagattactgtgacttccaacggcaaaagcgccagcgcgaaaagcctgtttaaactgcagactctgggcctgactcaaggcaccgtcgtcaccatctccgcagaaggtgaagatgagcagaaagcggttgaacatctggtcaaactgatggcggaactcgagtaagtttttttccgggttcttttaaaaatcagtcacaagtaaggtagggttatgatttcaggcattttagcatccccgggtatcgctttcggcaaagcactgctgctgaaagaagacgaaatcgtcattgaccggaaaaaaatttctgccgacaaggttgatcaggaagttgaacgttttctgagcggtcgtgccaaggcatctgcgcaactggaagcgatcaagacaaaagctggtgaaacgttcggtgaagaaaaagaagccatctttgaagggcatattatgctgctcgaagatgaggagctggagcaggaaatcatagccctgattaaagataagcacatgacggctgacgcagccgcacatgaagttatcgaaggtcaggccactgccctggaagaactggatgacgaatacctgaaagagcgtgcggctgacgtacgtgatattggtaagcgcctgctgcgcaacatcctgggtctggccattatcgatctgagcgcgattcaggaagaagttatcctggttgccgctgacctgacgccgtcagaaaccgcgcagctgaacctgcagaaagtgctgggcttcatcaccgacgcgggcggacgcacgtctcatacctccatcatggcgcgttctctggaactgccggcgatcgtaggtaccggtagcgtcaccgctcaggtgaaaaacggcgattatctgattctggatgccgtaaacaaccaggtttacgtcaacccgaccaacgatgttattgagcaactgcgcgccgtccaggagcaggttgcgaccgagaaagcggaactggctaaactgaaagatctgccggcaatcacgctggatggacatcaggttgaagtttgcgccaacatcggtaccgttcgtgacgttgaaggcgctgagcgcaacggcgcggaaggcgttggtctgtatcgtactgaattcctgttcatggatcgcgacgcgctgccgacggaagaagagcagtttgccgcctataaagcggtcgctgaagcgtgcggctcgcaggcggttatcgtccgtaccatggacattggcggcgacaaagagctgccgtacatgaacttcccgaaagaagagaacccgttcctgggctggcgcgccgtgcgtatcgccatggatcgcaaagagatcctgcgtgaccaggttcgcgcgattctgcgtgcctccgctttcggtaaattgcgcattatgttcccgatgatcatctctgttgaagaagttcgcgcgctgcgcaaagagattgaaatctacaaacaggaactgcgtgacgaaggtaaagcatttgacgaaagcattgagattggcgtgatggtggaaacaccggctgcggcgacaattgcgcgtcatttagccaaagaagttgatttctttagtatcggcaccaatgatttaacgcagtacaccctggcagttgaccgtggtaatgatatgatttcacacctttaccagccaatgtcaccgtccgtactgaacttgatcaagcaagttattgatgcttctcatgcagaaggtaaatggactggcatgtgtggtgagcttgcaggcgacgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaatccacgagatgcggcccaatttactgcttaggagaagatcatgggtttgttcgataaactaaaatctctggtttctgatgataagaaagacaccggaactattgagattgttgccccgctctctggcgagatcgtcaacatcgaagacgtgccggatgtagtttttgctgaaaaaatcgttggtgatggcatcgctatcaaaccaaccggtaacaaaatggtcgcccctgttgacggtaccatcggcaaaatctttgaaaccaaccatgcgttctctatcgaatccgatagcggcattgagctgttcgttcacttcggtatcgacaccgttgagctgaaaggcgaaggcttcaagcgtattgctgaagaaggtcagcgcgtgaaagttggcgatccggtcatcgagttcgatctgccgttgctggaagaaaaagccaagtctaccctgactccggttgttatctccaacatggatgaaatcaaagaactgatcaaactgtccggtagcgtgaccgtgggtgaaactccggttatccgcattaagaagtaattcttgccgcagtgaagaatggcgcctttgggcgccatttttttgcctgtacttgcgccgccatccggcgatggtgcagtgcactgcctgatggcgctacgcttatcaggcctacaaggttgcgaacatttcagcgccaatccacgggttacaactgcgaggtcaccgggcgaaagcacttctcgcgcatcaggatcttcatcccatccgggccactctccagcatcctgcgttcggaatcggacacttgcagctcgcactgatagccgccagtgatgccaaacatcgctcgcgccacgcagatatcttccagcgcgtccagcccgctcgtttcaaaatgccccacgatacgtccctgctggcgaaccaccagccgataactcttcatcgcgcctcccctgccggcggcagaattaactcatcacagccacactgctgtgtccaggtcatcacctccagcacgcgctgcgccgcatcttttgccgcggtcgtcagttttttcccctgcacaataccgctgaccagctcggcgcagaagagatctcccgtcccttttaactccgtcgccacccgcggatgggcaaagacctccacgacctgcgcagtaacgaccgcaaccgttatggtctccagagactcgcccggcgcgctggtgataaccacccatttcaacgtatcggaaagcagcgattgcgccgccgccaccgcctcttccagcgtgcggcacggtttaccactcagcatctccagctcaaatacgttcggcgttagcccctgcgcctgcggcaacaaatgcgtgcgataagcctgcggaatttccgcctgcacatacattccactgtcggtatcgccaatgaccggatcaacaagaatacacacctccggatgcgaagcccggatcgccattagccacttcgaaagcaagacaatttggtctgcgctgcccatgtaaccggtggtaatcgcttttaattcacgtagcgcatcgcgctcattcaacgccgtaaggtagcctgcaaaccactcggcgggaataatgccgccataaaaggttttatagtgcggcgtattgctgaatagcaccgtcgggaccgccgtcacgcgtagtccctgcgctttaatggccggaacagcgatactgttgcctacgctgccgtacacgacctgtgactggacggcgacgatatcggtctgtaatgcccgatggttgtcgtcgaagagcactgactgaatatcactctcttgtcccataaaattttcctctcgctggacagcaggctaccgcctcattatcattgtcatatgctaaaattcattttgtcataggtcaataatgatcgacggaaaaaccgctaacgaaatttttgacagtatccgtcaacacattatcgccggcacgttacgggcggaggattcgctcccgccggtacgggagctggcaagcgaattaaaggtgaaccgcaataccgtcgcagcggcgtataaacggctgataacggcgggactggcgcaaagtttaggccgcaatgggacggtgattaaaggcagtccgtctcccgtagcgctggaaggcggcgatccacatacgcctctgcacgacctttccggcggcaatcccgatccgcagcgtctgcctgaccttagccgttattttgcccgtctcagccgcacgccgcatctctacggcgatgcgcccgtttcccctgaactacacgcctgggcggcgcgctggctacgggatgccacccccgtcgcaggcgaaattgatatcaccagcggagctatcgacgccattgaaagactgctttgcgcgcatctgctgccgggcgacagcgtcgcggtggaagatccctgttttttaagcagtatcaatatgctgcgctatgccggttttagcgccagcccggtcagtgtggatagcgaaggaatgcagcctgaaaagctggaacgggcgctaaatcagggcgcgcgggcagtgatcttaacgccgcgcgcgcacaaccctaccggctgtagcctgagcgctcgccgtgccgctgcgctgcaaaatatgctggcgcgttaccctcaggtagtggtcattatcgacgatcacttcgccctgctttcttcgtcgccctggcagccggttattgcgcagacaacgcaacactgggcggtgatacgctccgtttccaaaaccctcggccccgatttacgtcttgctattgtcgccagcgacagcgcgacctcggcaaaacttcggctgcggctaaatgccggtagtcagtgggtcagccatctgttacaggatctggtctacgcctgcctgaccgaccctgagtatcagcacaggctgacgcaaacgcggctgttttacgccgcccggcaacaaaaactggcccgcgccctacagcaatatggcatcgccatttctcccggcgacggcgtgaatgcctggctcccactggacacccatagccaggctaccgcgtttacgttggcaaaatccggctggctggtacgtgagggagaagcctttggcgtaagcgcgccgtctcacggtctacgtatcacgctgtcgacattaaatgacagcgagatcaacacgctggcggctgatatccatcaggcgctaaatcgctaacaggagaaaataacgtgcgagttcattttgttgtccatgagtcgtttgaatccgctggcgcttatctgaaatgggctgaagatcgcggttataccatttcatggtcgcgcgtctatgccggagaagcgctaccgcccaatgccgatgagttcgatatgctcgtggtatttggcggtccgcagtcgccgcgcaccacccgcgaagagtgcccgtactttgactctcgcgccgaacagcacttaattaatcaggcagttacggcccggcgaatggttatcggcatttgtcttggttcgcagctcattggcgaggcgctgggcgccgctgtgtgccaaagtccggaaaaagagattggtcactaccctattacgctcactgaagccggtctgcggcatccgcttatcgcccactttggctccccgttaaccgtcggccactggcacaacgatatgccaggactcaccgatcaggcgaccgtgctggccgaaagcgaaggctgtccacgtcagatagtgcagtacggtaattttgtctacggcttccagtgtcatatggaatttaccgtcgaggcggttgaaggattaatccaacattcgcagcaggagctggccgacgcgcaagggaagcgttttatccgctcggtcgccgagatgcgcgcatggaattaccagcaaatgaatgaaaagctgtggcgttttctggatgaactcacgctggcgcactcacagaaataaccacaccaggagtgcaacttattacccggctaacggtctgaggtgcagtgattattgcatgaaaaaggattttaccatgaagaaaattgtttgcgccgtcgttgcgctcctgctgaccctacccgcctgggcgaagctgaacgcccatgaagaagcgcgcattaacgccatgcttaatgcgctggcgcagaaaaaggatctgacattcgttcgtaacggtgatgcgcataactgcgaggaagccgtatcgcacctgcgcttaaaactgggtaacacgcgcaatcgtatcgacaccgccgaacagtttatcgataaagtcgcgtcgtcgtcgtccatcaccggaaaaccctatatcgttaaaattcccggtaaaagcgatgaaaacgcgcagccttatttacatgcgcttattgcggaaacggataagaatgttgagtaagaaaaaatcataatgccaggcgtgttactgtggttttttaaaggcgttatcgcgcttctgttagcgtttgctgtagggttaatcgtttactattatctggaaattcgtcccatagcccagaccgcattacagagcgcctctttctggttgtccgaatcgccgcagacgcgttttttgcgccgcgctgcggccaaaatacatcccaaatcttatactgccagattgctctatacccaagctggcgtggatgggcatttcaggatcgcgatctgggtgttctggttggacagcctgtaccgcgacgacgagctgtatgccatgatgctggcgcaagcgtattatggccgggattcgcagggtaacgcggtttacggtacgaaaaatgcggcgttaacgttatttcacgtaccagtgacagagatggcctgccagcaacaagtacaactgatttatatgtttaaagcgccgtcactttaccggcctggttcagccaggctggtagaaagcagcaagcattacatgacgctttgccaggaacaaatacaacaataagaacaacagacgagcttttattataaaaggcggcggtaatgcgctggcgcacatagaaaatcggcaggatattcccgcttgtcaaaggcgccgttgcctgtgtttatcccaatcagctgaactcattagtttaaatccctgccccctggctgaaatgctcttcaccaaacacgccggtcgaaaggtaacggtcgccgcgatcgcagatgatcgccaccactatcgcgccgggcgtggctcgtgcgacgcgtaacgcgcccgctaccgcgccgccggaactcacgccgcagaaaatgccttcacgaacggccagttcacgcatggtgttttcggcatcattctgatgaatatccagcacctcatctaccagcgaggcgttaaaaatgcccggcatatattccgcaggccagcgtcgaatgcccggaatactgctgccctcttccggctgtaggccaacgatggtgaccggtttttcctgctcgcgcagaaaacgcgacacgccggtaatggtgccggtcgtgcccatgctggagacaaaatgggtgatgcgacctgacgtttgccgccagatttccgggccggtggtcgtgtagtgggcgtagggattatcaggattattaaactgatcgagcagtttgccctcgcctcgttcagacatagcgagcgctaaatcgcgcgccccttccattccctgctctttagtgaccagaatcagttccgcgccataggcccgcattgccgcccgacgctcctgactcatgttgtctggcatcaacagcttcatgcgataacctttcagcgcggcgatcatcgccagcgcaatgccagtgttgccgctggtcgcttcaatcaggacatcgcccggtttaatttccccgcgcttttccgcctcgacaatcatcgatagcgccgcgcgatctttcaccgatcctgccggattattgccttccagcttgacccagatttcactgccgttatccggccccagacgttgtaatttgaccagcggcgtattgccgatggtttgttctaatgtattcacgttttcagctcgtaaaaaagcccggtatgcgtagcgccaccgagcgataactatacaaattaacctatcaggccgattgcgccagagcaagttcctcttcacgcgtttcaatacgctggtcgccgttatacagacgcgctttttgcagtccaacaaacaaacgctcgccgcgaaccggaacatcctcacccgccatcaccaccgtcagcggatcgtgataccaccccagcggctgtaccactaactgtgtatagtgacctttcgggctggcctcaatgacctgtactggtagaggagaatccaggctggtgcggcggctaatatccacctcccacggacgcaggaacagatcgaccggcccctggtacgcgggcgtataacccagcggccagcgatgcgcgccaacgtgaaactgcccgccgcggacggtgcctgtcaggcggttcacctcgcccataaactccagtacgaagcgggttgccggttcacgccacacccgatccggcgcatcagcctgttcgatattgccctgactcatcaccaccacccgatccgccacttccgtcgcctcttcctgatcgtgggtgacaaagacgctggtgaatttcagttcttcatgtagctggcgcaaccagcgacgtaactctttacgtacctgggcatccagcgcgccaaagggttcatccagcagtagaatttgcggttccacggcaagcgcgcgcgccagcgccacgcgctgtttttgtccgccggaaagctgggcggggaagcgatccgcgaggtgcgccagttgcaccatctccagcaattgcgtcactttcgttttaatcgccgccgcagttgggcggtcgcgtcgcggcagcaccgtcaggccaaaagcgatgttgtcaaacaccgtcatatggcgaaacagcgcatagtgctgaaacacaaaaccgactttacgctcacgcgcgtgcaggcggctaacgtccgtaccgtggaaacgaatatgaccgctggactgatgctccagcccggcaataatgcgcagcagcgtcgttttgccggaacctgacggccccaacaaggcaaccatctggccggaaggaatatccagcgagatatcattcagtacctgagtgcgaccaaaggatttcttaattctggcgatctcaatgctcatgattttcctcctgttgcgcgcgtttttcctgattctccagacgccattgcaacatgctcttcaaaaacagggtaataatcgccattagcgtcaacaatgcggcggcggtaaaggagccgacggtgttgtagtcctgctccagtaattcaatctgtaacggtagcgataacgtttcgccgcgaatcgagccggacaccaccgacaccgcgccaaactcgccaatcgcgcgggcgttggttaacaccacgccgtagagtagcgcccagcgaatattcggcaacgtcacgcggcgaaacatttgccagccggatgcgcccagtaaaatcgccgcctcatcttcctgactgccctggctgagcatcactggcaccagttcgcgcaccacaaacgggcaggtgacaaaaatagtgaccagtaccatccccggccaggagaacatcatttgcaaattatgctcatccagccagccgcccaacgggccgttggaaccataaaacagcagataaaccagaccggccaccaccggcgagacggcaaagggaatatccagcagggtcagcagtagctgacgtccggggaagttaaagcgcgtcaccagccacgccagcagaatgccgaacaccagattcaccggcactgcgatcaaggcaatcaacaccgtcagccagatggcgtgcagcatgtccggatcggccagattttgcagtaccggcattaaccctttgctgaacgcctgcacgaagatgtaaatcatcggcaccagcaggataaacgccgaaaccagcatcccgacgccaatcagaaaccattttccccagttaatgcgggggacgtcgtatcgcttcaattgagtcacttccgccattaatgacctaccacacgtcgaccaaagcgactttgcaaggtattgatagagaacagcagcagcaaggatgccgcaaggatcaccgaggcaatggcgctagcggccgggtaatcaaactcctgcaagcgcacaaaaatcatcagcgaggtcacttctgttttccaggcgatatttccggcgataaaaatcaccgcgccaaactcgcccaggctacgggtaaaagagagcgccacgccggcaatcagcgcaggcgacagctcaggcagcacgactttgcgaaaactttgcagccgggtggcccccagcgtttgcgccgcttcttcatattccggccccagctcttccagtaccggctggacggtgcgcaccacaaatggaatactggtaaaggccatcgccaccgcaataccgagccaggtataggtcactttgatatcaaactgcgcaagaaactgaccgtagaaaccgttcactgagaacagcgaggccagcgttaaccccgctaccgctgtcggcagcgcaaacggcagatccatcagcgcatccagcaacgtgcgccctggaaaacggtagcgggttaaaatccacgccatcagcaggccaaacacgccattaaaaatcgacgctacaaatgccgccagtagcgtcactttataggcagccaccacctgagggttggtcacgacatcccagtattgcgcccagctcatctgtgagagctgcatcaccagcgcgctcaacggcaacagtaggatcaggcagacaaacagcaaactggtgccgaggcttaacgtaaagccgggcagcacgcgtcgggaagaaacggcaagcattacttacgccccgccgccaacagtttgtccagctcgccgccgctggcaaagtgcgttttcatcacttccggccaggaaccaaacttttcttccacgcggaacagttcggtctgcgggaatttatctgcttgcttgcccatgatttccgggttattcacgcggtagtagtaatgggtgatgatggtctgcgcctgcgggctatacagccagttcaggtaagctttggcggctttttctgtgccgttggcctgcacgtttttatccacccaggcaaccgggaattcagcaagaatgttcgttttcgggatcaccacttcaaatccctgggcttcatattgtttgcggatattgttcacttccgactcaaaactaatcagcacatcgcccagaccacgctcggcaaaggtagtcgtagcgccgcgaccgccggtatcaaacacttcgacgtttttcaggaactgggtcataaactgttcggttttggctttatcgccgccgtccgcgttatccgccgcgccccatgccgccagatacgtgtaacgggcgttgccggaggttttcgggttagggaaaatcagcttcacgtcggaacgtacaagatcgctccagtcgtgaatatttttcgggtttcccttgcgcaccaggaaacccatcgtggaatagaatggcgaactgttgttcggcagacggctttgccagtcggcagggatcagtttgcctttatcatgaagaatctgtacgtcggtcacctgattgtaggtgacgacgtctgccttcagtccctgcaaaatcgccagcgcctgttttgatgacccggcatgagactgcttaatcgtcagcttatcgccgccgttatccttcgcccattgttgctcaaacggcgggttaagggcggcaaacagctcgcgggagacatcgtatgagctgttcagcagctccgttgcctgcgcctgccctgccagtaacagcattgctgccagcgtcaggggtctctttttcagtaagttaacggccattgcgcacccttataaatttaatgactttcttatggtcatcatatttataaccagcgctaaaggagtaacggttttatataccgtttgatgatttgaaagttgaaaagggaataagagaatccctccccacgcggcgtgaggaggagaccggcatcaatcagacgcctacgcttacgctttcaggcagggtactgccgccatcaatgacgttttgcgttccggtaagatagctggactcatcggaagccagaaatgccgccagttcccctacttccagcggatcggcaaggcggcgtagcggaatggcttttgccatttccgttaataccgattccggatcgtcagggttagactgacgggcaatgctttccgccatcggcgttcttacataaccggggcaaatggcattcacacgaataccggactgcgcatactctaccgccagcgatttggttaaaccgacaatggcggcttttgacagcgcataggccgtttcacccgggtccgccaccatatctcccgtgacggaagacatcatcacaatgcggccatctttacgtttaatcatctccggcaggacggctttggtgacgttccagacacctttaatattaatatcaatgtggaaatcgcgatcttcttcactcatatcgaggaagttgcccagacggcacacgccagcgttattcaccaaaatatcaattctaccttcagtctctttggcgcgcgcaaccgccgcctgcaccgaagcaaaatctctgacgtcagccttaacggcagtgcagcgatgcccgcgcccgcccagctcatccgccagtttttcaatctcatcggagatatccagcaagattaagttcgcgccgtggcgtgcgaatacgcgagcgatcccttcgccaatgccctgcgatgcgcccgtaatcaatgctgtcttgcccgtgagtttacccattttcaatgtctccttttgaatatggagtcttacactccattaacactgaaaatacagtaataacaaataagtgctgaggaatagctcactaattcaggtaaatattaggtaaaaaaatccccgcggaggcggggatgggcatttttatgctgttctgcctgatggcgctgcgcttatcaggcctaccaatcgtaggtcgaataaagcgtttgcgctgccatccgacagggttttaccttatagcgctaacaggcgatccagcgacggcgcaaaatagtagccgccagtcaccggtttggtgaagcgcagcatcgcgtcgcgtttaccgtcggtatcgccgaacatactcagaagctgctgttcgatattgtgcagacgtgcgcagtaagcgcagaaatagagaccatgagtaccgctggcggtgccgtatggcaggctctggcgcacaatcttcagccctttgccatcttctttgagatcgacgcggctcaggtgagatgttgccggacgcgcatcgccgtcaatctcttcattggcttctttggtacgcccgatcatcatctcctgatcgtgaatactcatccggttaagttgcttgagattgtgttcccaacgctgcacgaacacataactgccgccggcatccacgccatctttgatcaccgccacttcacggcgcgtctcttcgcccgccgggttctctgtcccgtcgacaaagccgctcagatcgcgttcttccacccaacggaaaccgtgaacttcttctttcacgtcgatacagtcgccgaaggcttccatcgccgcctgggcaacagaaaaattcacatcgtggcgcagggaaaggatatggatcagcacgtcatactgcgtggccggtgccagccctttaccataaggaataaaatctttcagttcttccgccccgacgccgccactcagggcacgccaggtattgttgccaaacgccacaacggccccaagatgggcgtccggaaatttgacttcgaaggtcgccagtttatcggcaaatgttctgctggccgcgcgcagggcgtccaggtcgcctttcacattggcttcaatccaaattgccgcacggcaatgttccggcaaaatgccactttgaacctgagacatgattcctcctgaaaatgagaatgccacgcagtcgtggcattaatggaggctattttaccttgtttttaagcgaagcggtttgttcaggcgcaaattaacgacgccagataattttgcgcacgtcccagttttttaagacgtcatcaggaggcattaagccttccggtccgctccactcgccggagaaaacatagctaatatgctgacttccctcggctttacattcgacgctggtatggctatcgctggaaaccggctcgcagtgaccaaacgctttgctgtaaaggtcgctaaacggcgtaccgattttgccccccgcggcggttgggatatcgctgtccagcacatcaatacggctcacggttccctgctcgccgttgatcaccatcgcgacactgtcgcccttcatcgcttcgaaaaagcgcaccacgttgccgttatcggttttcataccgctacgcaggcgataatcgccatctaatgcctctgcaatagccggctcttccagcggcgtggcggcggtcagcgctcccacgccttgctcagtgacttctgtcgaggaaccaaaccagttccatggatttgcggcagaccagttgaccgaggagagcgtcgagcagccggtcaccgccagcggcagtgcgagtaaagtcaaacgcagcgatttcatctcacttcctttcttttattaattaacgttggttggagtgcgggttcgccaaaaagtgccgttattctttctcaagggaaaaacaggcacgcaaacgttgattggttaacagccagatcagcgcgacgatgtccgccagcagcagcgccagcccgacgccgttgaccgggtcgccacccagccacatcaccggcagccagcacaacgacaccagttgagcaaggatcaggagtccgcgcagccagcgccacacaccaggaaccgcgtcacgccgcccgctgagtaaaaatgccactaccgccggaacgccgggcaacagccccagccaaaaattgtcatggtcgggataaaaaaagtttaacaaagtattaccctgtccacgggatgaaccggcaatgacaaagagtacccaggcgcgcgcctgaagtagcagtacgcaccagaacagaaacggcaggcgtaaacgtccgtgtacatcataatcggctggatgaaactcagtactcttcatcttcaatcaggcgtttacccaaacttagggcgtcagaatgctcataccccagacgttcatacatgcccagcacaacgtcgttatcatcgcgcaccataatttggattttcggacacccgcgagcgatgagttttttttccagccggttaagcaacgcattcgcaatgccgcgcccgcggaactccgggtgaacgcccaggtaatacgccgagccgcgatgcccgtcataaccgcccattaccgtaccgacgacttcgccgctaacttccgcaacgaggaacaagctgacatcgtgattcaccttgcgttcaatatccatttcaggatcgttccatggacgcagcaggtcgcaacgctcccagagggtgatcacctcttcgaaatcttcctggcgaaaaacgcgtatttccatggtattcgttgccttttcgggtggaaaaaccaagattatggcgcaaacatctgattcagccaatatctgacgcgatgtagcggaaaaaatggcataatggcgatgtgtcacgtattgaaatgaaaagtaaaacaattctcatcaccaaccgtcgtaacggattacgcgatacgatataacatcttgaacttaattttcacaactcaggccgtatgagcacttttaaactcctaaaaactctcacatcgcgccgccaggtactcaaaacaggtctggcggccctgacgctgtcaggtatgtcgcacgcagtagccaaagaagaaacgctaaaaaccagtaatggtcacagcaaacccaaaaccaaaaaaaccggcagtaaacggttggtgatgctcgaccccggacacggcggcatcgataccggcgcgattggccgcaacggttctcaggaaaaacacgtcgtactggcaattgccaaaaacgtgcgcgctattttgcgaaatcacggaatcgatgcgcgtttaacccggacaggggatacttttattccgctgtacgatcgggtggaaatcgcccataagcacggcgcggatctgtttatgtccattcatgccgatggttttaccaatccgaaagcagcgggcgcttccgtttttgcgctttccaaccgcggggccagtagcgccatggcgaagtatctctccgagcgtgaaaaccgcgcggacgaagtggcgggtaaaaaagccactgaccgggatcatctattacaacaagttttgtttgatctggtgcaaaccgatacgattaaaaacagtctgacgctgggttcgcatattctcaagaaaatcaaacctatacataaattacacagccgcactaccgaacaagcggctttcgtggtgctaaaatcaccgtcaattccgtcggtgctggtcgaaacctcgtttattaccaatccggaagaagaacgcctgctgggcacgacggcgtttcgccagaaaatcgctacggcgatcgccaacggcatcatcagttattttcactggtttgataatcagaaagcacacacgaagaaacggtaatcatgaaacccgatgcacatcacgtaaaacagtttctgctacgcctgcaggatgatatttgccaaacgttatccgctgtggatggcgcaaactttgtcgaagatagctggcgacgcgaagcgggcggcggcggacgcagccgggtattacgcaacggcgggattttcgaacaggcgggcgttaatttctctcacgttcacggcgatgcaatgcccgcgtccgccaccgcgcatcggccagaactcgccgggcgtagcttcgaagcgatgggcgtatcgctggtggtgcatccgcacaatccgtatattcccaccagccatgctaacgtgcgcttttttattgccgaaaaaccgggcgccgatccggtatggtggtttggcggcgggttcgatttaacgccctactacggctttgaagaggatgccgttcactggcaccgcaccgcccgcgacctgtgccagccgtttggtgacgatgtgtatccgcgttataaaaagtggtgcgacgactacttttttctcaaacaccgcaacgagcagcgcggcgttggcggcctgttttttgacgatttgaatacgccggatttcgaccactgcttcgactttatgcaggcggtcggcaacggttacacccgggcgtatttaccgattgtcgaacgacgcaaagcgatggtctggggcgagcgggagcgtaattttcaactttatcgccgcggtcgctacgtggagttcaatctggtgtgggacagaggcaccctgtttggtctgcaaaccggcgggcgcactgaatctatcctgatgtcgatgccgccgctggtgcgctgggagtacgactggcagccagaagcgggtagcccggaagcggcgctgagcgagtttattcaggtacgcgactggatttaacttatttataaagtaaaacaatgcaaacaaatacacggaaagtagtaaccagtgacgccaaatggcatccccatctgggtataagttttattggctgcctgcttgccattacactagaaatatattttgaagaaagaatattcatccctcatagcggaggggtgagcttcggtctgatcgtgcttctggttatcaatatggtgaccatccctgtggtcatggccctgatagcattactctgctttattattcatattccgcgtaaaagcgttaactgtatcttgctatgcctactgtcatgtattttgacgatagccggtttgtttatcgcctatccggttggccgttgaataaaagcaggctcgtagaaataaacgagttcattgtagataaagaattcggataaccgcccgctgccgttatcattagtaaaacagtacagtaagcactcgtagaatttgcagtggagcactaccgcatggacgagcgtattccttgtaaaaacccgcaatgctcacacttcatcctgccagcaacggctgcccgcacggagggctattgtatgccctgcgtccaggcgcgctatcggcaagtgcaggaagaatatatccggaaaaacagaaaaacgatcgacgcgttcagtggcattaccaaccctgttgaaatgcttaaactcgttcatgaaccccgggaacacgatccgttaatcgagtggattccctgccccattccgaccgatgagctttacaaaaagctctccgatgatgaaagccgcgacatggtcgattatgcagaagaattatttgattccggatggcaggaggaagctcaggaaattgcgctgtgcctggcggcatttacccaggccaatctggataatttcctgcgccaggtaataaatgaagaagaactggagctctcttcacccctaccttttcaccgtgcgccgcctgacgtacgcgacgcgcttttgcagaaggtggaaaccgatgacgaaaaccgtgacggcattctttgtgccctggcctggattggcgatgaggttgtcgttgagcattttaaccgctggcgccaggaaccacctgcgtggagtgcttcacttcatatcctccctcatcgctatgctcaccaggcgggatgggagctcactgaaaatggccgcaggcgcgatctttactttacgcaatgtacccatctggtaaaacaggcacctgaacagccggccgtttttcgcgccgttgcagaatatggtgaaaactgcccacactgttccctgccgctaatcaatctgtttgaggttgcgccgagcgccgtcggcctaagcacgcagggttggcccggtcaaattcgtattctgacctgtcagtgttgtacggcatataacaccgttttcgccaccgtcgatccacaaggccagccgcgatggtacgaaaaaaatgcgctctcgacgctggcggtggagaattccgctgactggataacgctaccgcttgatgttctgcaccccggggaatcccgtttgccgctattcgctgctgaaatatttttacccaccaccttctcacagctcggcggccatcccgcatgggttcaggatacagactatcctacgtgcccaacgtgcgcgcaaacgatgatgtttcttgcgcagctaagctatgaagatatcgaggaagaggaatatgcggaaggaatgctttacgggtttatctgcccctcctgccaaacaacggcaacgtcttatcagcaaacataaacgctcatcctcatgatctgatgacaaaactgttttgcacgttgtgcgcgcgcttccccggaggcggcgctggcgcgccttgtccgggctaccaaccacagacagcagcgaatccgtaggcccggtaaggcgccagctgccaccgggcaattcccgacacgcgcacgttatcagcaaccggagagcctccccatcaatatcaagcccattgccgcatccgttgatgcagcgtcaacgacggtttttcggcaaataattgctgataatcggtggcaaattgccccagatgccagaatccccactgcatcgcggcatctttgaccgtggcgctctgcgaccacgggctaatcagttcccggcgtactgcgtttaagcgaatacgtttcagccacgcattggggccaatgcccaaaatggcgtgaaacgcattttgcagcgtgcgacggcttacgtgtagctggttacataagtcgagcaccgtcagcggctccgacatattttccagcacatattcccgcgcccgcgacagtagcctacgatatccctgatggctgatgctttcggcgctatgaatcggcttcgcctcttccagcatcgtgcccatcgccagcaataaattatcactcaagaccttacgcaccgcaggttgatgcagagtttcaggactctcgctgaaggtggccagcgcctgctgcacaaagccccacagcgctgctttatgctgctcttttacctccagcgctagctggttacgcagcatatgcagcaccctttccgggttatgcaaaaacgtggcctgacgggaaataacatcttccgagataacgacgcccagaatggtgtaatcatccggcgtgctcagttcaaactcggtgcctcccggtcgggtggcaatctcggcgctgccgagcccctgcgcgccgataaatccctgttcgccgcgcgtcgccggaataccaaaccagaaagagtttggccaaaccagacacgactgacgcagcgccaggccggtgtattcacggaacacctgaatctcatcaagcaggatttccgtgaactcgccatgaaatttacccgggtgtaactgatcgtagatctgctgccaggcggtgatagtcagagcatgttcatagacatccgtcgtccgtcgctgatgaacattgtccacctcgactctgggcgtaagtttaacgtcttcgggtaacgcttcatgataaagatggtgcaaattcgctgtacgggtctttttcatgatcttctatgccggacgcccgccaggacgcccggccctccgacagattaatttttgatgcgatagcgactactgcgtttacgcaacgctccgtcagaaaagagttgttccagcacgtttctggcctgctccagcggccagccaaaatgcgcggcaacctctcccgccgtcattccctggcgtactgatgccagcagcgccaataacgcctcagcgaactcaggcgttgcgggtacctggggtgctttctcagtcggcgttgtcgcacgcgcaaacccgccaatcagccactgggtgtcctcttccggacgaccaatttctttgcgactaatcacacggcctgtgcgctgcgcggcagcgcttccggcatccagcgccgcacgacacgccgccagatcgccctccaccaccagcgtgagcctgccagggtcgagcacttgatgactgagcaaacgcacgttggccgctttcagcatagcatccgccgcatcgacggcggcgaccattccgtccacttccagtaatcccagggcattgatcattggcagcctccgttacgcacgctggacagggttacgggcgatatccagcacggcgtcggtaaaggcgttgcaggcggctttacacgcggcctggcttcccgttaagaacgcggccgaatagttggtttccgacggcggcggcacgtaagtcaccagctgaacgtcagcggatttcatcgccgcgtcaatgccgaatgtcgcttccagcggcggcgccaccaggtaggccattggatcgcccagcgcgatacctgcggtagacgagaggtacgagccggtacgcgaaaccacatgcgccaggaatgcggtattttccgcatcgttcgcccactggaacgccgcgccgttttcaatgctggcgaccattgcatccagaccggcgcgcacttccgccgggttcggtccgcccagcataatcaacacctcaccagcggtaggcgacggcccgtgagccgccccggcatagagggagcggccatagaccacttccaccatcgcctgttttgtcgcttcgtcagcggcaatataggtcacatcatcagaatctgccgtgatgagtccgagactacgtatatgtggcggtaatttaagttcccgcgcaaagccgtcattcacggaggcaatcacgcgcatggcagtcactgaaggtcgaattaaatctaatgcaggcatgatgtctccttaacgggtcatgttgatgccggacgctttctgctccagcatccgtttggccaaatccacaatcacggcggcggcttctactggcggcgtccccccctgatgaatgtttgaaatacaggttctgtcggcctcgacggtggtcgccacgcgcggggaatagaccgcgtagcaggaaaggctttccgactgccccagccccggacgttcgcctaccagcaggatgacgaccttcgcgccgagaatttcgccaatctgatcttcaatcttcacacggccatagcgcacaaagaacggcgtgccgacgttcagcccggcctgcttcagaccggcaagcaacggcggcaggatctcttcatagttggcggtgatcgcatccgtagagaggccatcggagaccactacctgcacatccgggttcatcacgcactgtgacttcagcgcgtcaatggcttccgggctcaggcgacgccccatatccgggcgcgtcaggtacaggtttttgtcgctgatctccgaacgcacttccagcagcccttgcgcttttacccactcttccggcacttctttgagcacggtatctttcgaacgggagtgatccgccaggaagcgcaacagcgcctgggtgcgcggacgcggcccggcacgccccgtacagacgcgtgccgcagtactgcgacgcagttcggtcagcacgtccgcacgatgtgggttctcgacgccaatccaggcttttgcctccgcggaacctaaatccagcgcgcagctttcggtcaccgtcggcgcggcgcactgcggctttgcgccttcctgcgttgacggcgcggcgggctgcggtacgtcctgtcccattgacgccatcacgctacgtacaatttcttcaatctgtttttgatccatggtgttatccccgcgtcatcagaagaacagtgacggatcgcccgcccgtttggtcagacgaccgtttgccataatgcccatcgtttccagccagcgttcaaactccggcgacggccgtaaattcagcaactgacggacggtggcggtatcgtggaaagcggtggtctggtagttgagcatgatgtcgtcgccgagcggcatccccatgatgtagttacagccggcagtggcgagcagaatcatcaggttttcgttaaggttctggtcggcgtcggcatggttggtatagcagcagtcgcagcccatcgagatgccgctcagcttgcccataaagtgatcttcgagaccggcgcggataatctgcctgtcgttgtagagatactccggcccgataaagcccaccacggtgttcaccaggaacggatcgtagtggcgcgccagcccgtagttacgcgcttccatcgtcacctggtcggcaccaaagttcgcgcctgcggagagcgcagacccttgcccggtttcaaagtacaggcagttttccccggcgatgcggttgaactccgcccccacagcccgcgcttcgtcgagcatggccagctcgacgccgaactcttttaagcccttctcgctgccgcaaatgctctggaaaatcagtccgcccggcgcgccgcgacgaatcgcttcgatctgggtggtgacgtgcgccagcacgcagccctgggtcggaatattgaatttatcgataacgccgtaaacggtgtcgagcacgcgggtcaggttctccacgtcatcggtcaccgggttaacgccgatcaccgcatcgcctgcgccgaaagaaagcccttcgtagatttgcgcggcgatactctgtacatcgtcacgggtatcgttcggctgcaaacggcagctaaaggtgcccggaataccgatggtggtattggcttttttgatcaccggcattttcttgccgccgtagatcaggtcagcgttggagcagattttcgctactgccgccaccacttcggaggtcaggcctttgcgggtaaacgcgatgtcgtccacggaggtttcatcgctcagcacgtattcacgcagttcgctgatgctccagtttttaatccggttataggccgtttcgttgacgtcgtcctgaatcaggcgcgtcacgcagtcctcttcataggcaatcaccggattgttgcggatatccgccaccgtcatttccgacagtacctgttttgccgctacgcgctcctgcgaacttgccgcggcaaccccggccagcacatcccccgaacgcagttcgttggctttagccagtacctcttttacatccttaaactgataaacattgccgaacaatgtggtctttagtttcataagtcgttccctcaggaaggaaatgcgagtgatttcaccgtcaccggcacaaccgatccgccaaaaagaggcgtaccaatgtcgatatagtctcccgcccgcacgaccacctcatcgatgaccgccagcggaagttgcggtaactgtgggcgcaataacatgcccagcgctttaccaaaatcctgctcggccaccaccagcaggggatgtggattgggataacgcgcgacaaaagccgtcagcgcgttgatgaccgtgagtaatgcggcgtaacgcaccggaagcgtggcgggaagcgccagcacgtaagcgtcggtttgcgggtcgagatcaagctggagaagcgcctgccgccaggcgttcaccagatcggcgtcatcctgcgggatcgccaccggcaggttgcgcagcggcagttggacgtcttccagccagatagtactgccggaaagcgagagcgtatgggcccccgcgccaatcaccgtggcgcgcacggtttgcgccggaaactgcacgttcatctcgcgcagacgcgggtgctcatgcagcgcggtcgccagcagcggcccgatatcagaaaagcagaacggatcggcaggttggttgcggtagcattcacctaccccaccggaaagggtgatcacctccggcgtaatatcggcgggcagcagcccggtttgcatcagcgattgcgccagcggcgagagcgcgccagtgataacctcgacgatgagatccgccatccgccgcgccacctgtcccaactgtgcggcagctaaggcgcgagcatcagtacccgaaccgaacacctcatcgataatcatctgccccggctgatgggcataaaccacgcgcccctgagcatcggtttccagcaggcgaccaccgacgttaaggcaggcggtgccgctgacttttcccgcgtcaaacagcgcgtagttagacgtgccgccgccgatatcaatattcagcacccggcacatccgctgctcagacaagctttgcgctccggcgccgtgaccggcaatgaccgattccagatgcggcccggcgctggcgaccacaaagtcgcccagcgactgcgagagcgccatgaccgccggacgggcgttgcgggttttggcgctttcgccggtgataatgatagcccctgagtccaccgattcaggcgcgatgcctgcggcctgatactgggccagaatcagcgctttaagttctacctctttcagaccgccctgcttatccacgggcgtaaagaagaccgggctttgccagctaatgtcgcgtttgatgaattcgtagcgcggcacctgcgacaccgccgcacggttaaccaactccaggcgcgagaagatcacctgcgtggtggtggtgccgatatcgataccgacgctcagtagctggcgagtgttcacgattgcgcctccgcttcggttttcacctgggcggcgtcatctttcggcaccagcatcatcgccacgccaatcgccgtcacgccgccgatcagcttgccgacaatcatcgggaagatcatggcgttcatgttggcagcggcgaagcctaaatggtcgcccagcgcgaacgccgcagagacggcaaatgcgcagttaatcactttgccgcgggtatccatctgcttcatcatgccgaacatggggatattgttcgccagggtcgccaccatgcctgccgccgcaatattattgacgttcagcagtttaccgacattcatcaacggtttttcaaaccagcgggtcagtaacagcaccatcggatacgcgccaagcagcacgcaggagatagagccgatcacttcaatggcgcgcatcacttcgccgggtttgtcgcctggcgccataaagatcgggtcgagtcccggaatcaactcccaacccaacaggaatttaaccaccgcagctgccagaccgatggtgatcagcgctaccagaaatttggcgaagatctggaaaccgttgatcattttttccgggatgaacttcagccccagcgctaccagcaccgcgacgatcaataccgggatcatgttcatcaggatcagcgcgaaggtaaactccactggctgaccattgatctgcacacctgagtacatggcgatcagtccccccgcaatgcagccaatgggaatggtgacgatacccgccagtacgccaagcgccaggtagcggcggtcagacggttcgataatgccgagcgccaccggaatggagaacacaatggtcggccccatcatcgacccaagtattaaccctgagtatagccacgccgcgacatcaccgccggccagctctttggcgaggaagaatccgcccatatcacaggccagcagcgtacccgcgaacatggatgggttcgcgcccagcatttcgtataccgggataataaccggccccagtacatgcgccagcaccggcgccagcgcggtcataccgaccatcgccagccccagcgcgcccatcgccataaagccctcttcaaactggccgccagacccctcgatactcttgccgaatttaccgaggaagcgcgccgacccgccgaactgcgacaggattctgtccacggcggcaatcagcataaagaacatcatgatgtacatgatgatttcgttaattcccatagcccctactccctgtcatttttgatttgtaaaccggataagacgtttacgtcgcctccggcattaacgccgtgttattgccggatggcggtgcgagcaccttatccggcctacaggcattacccggcagccgcgtacaggtcgataatctgtgcctgtgtggcggtgcgtgggttactgcgcagacaaatatcctccagcgcggcttgcgcccacgcgctgtagtgttcgggtttggcgccagcgtcagccagccgtttgctctgtcccacttcggcaatcagctcgcacaccgccgcaatcgcatcgcgatcgtccgatttcttattggttaacgcccgacctatttgactgaagcgctcgcggcaaaccatccggttaaagcccatgactgttggcagcagcatggcgttggcctggccgtgcggaatatgcagcgccgccccaggctggtgcgccatcgcatgacacagccccagaccggcgctggaaaaggccattcccgccatacaggaggccagcaacatattttcacgcgccgccagatcgtggccgtaacccacggctttcggcagcgatttgccaatcatcgctatcgcgccaatcgccaggctgtcggtaaacggcgtggcgttgagcgcgctgtaggcctcaatcgcatgcgtcaacgcatcgataccggtcatcgccgtcacgtttggcggaacgccttcggtcacggcagcatcaagaatcgccacgtccggcattagtgacgcgtgcgccagcacctgcttgcgcccgctgaccgcgtcgataatcaccgttacgttggtggtttcagaaccggttccggcggtggtcggcaccgcaatcagcggcagacgcgggcgtaatgtactgtgctcggtcatggcgctcagcgtctggtcagggttagtcaccagcagggcgaccgctttcgccgcgtccagcaccgaaccgccgccaaaggccactacgccgtcgcacgccgcctcacgcagttgcgccaccgccgcgcagacatcggtgatgcacggctcgccaggcggacacggccagaccgtcatcgccacgcccttcatcgccaggctgcgtgccagcggcgcggtcattcccgcctgatgcaggaagctgtcgaccatcacaaacagatggcttacgcctcgcgcttgcgcttcctgtccacaggcgccgagcgccccaagtccgcacagcgtgaccggcggtacgctgaacgttttcacccgttgcagattcagggtgtcgaatgcctgaaacagcgccgtctgtagttcagcttgcatagagtccctccgctttcgctctcccgctgttggctatcgccagcggggtcataaacaggctgtgctgcggcaaatgcacctgtaactccgggaaacgctggcgaaataacgcctccacgcccggctgcatacaggagccgcccgccagccataaatcagcaattccttgcccttcaatgtggcgagcaacgatttccgccatcttttcgtacaccggcttcactaccggccaaatctcctgcgcattgctgcgcttgtactgttccgcctcttccaggggaatacggcggttgcccgccagcgtcagggagatatggtgcccgccagtggcttcatcggcggagtaagtcaccttgccctgtttgacgatggcaatgccggtagtgccgccgccaatatccaccacgcctgcattatcaagcgccagcagatccgctaccgccgtcggttcatccagtacatggctgacttctaacccggcagactccagcacgttgatcgaaatacgcgggtcggtgcctggcggaaacgaggtcgccgcgtgggtaaagcggcagccgagctgctgttcaagggtgtcgagatggcggcgcacgagggtgacggcgccgaagaaatcccagacgatgccgtcacgcacaacgtcggcccagtcaaggcataccgccaccggctgggcgttgccgtcgaccaccatcgacaccacgtcgcaggtgcccaaatcgacgcccagccacagcggtgtatcgctggcggcgggcgtctggttacacagggccgccgctttttgcagtcttggggtgagccagagttgttcgtcgtgcgccatgagtcatcccttatacaatgcgaaacgcatccaccagcacgcatcgacgcagccgcacaaaggtacgcgcgctggtcaccccttcgccggttggcgtagtgatagtcatggtggtccagccttctccgcccaatccaagcccggcaatgcacggcccgtttttgacgaaaatgctggtgtcgatggcgttcgccatctggttcatgttgtcgatattgcgcgagtgcatcgccgccgtatggtggcaaccgccttcaagctgaaccgccagggcgatggcttcttcgacgttggcgacccgcaccaccggcagtaccggcatcatcatttcagtaacggcaaacggatggttggcgggcgtttccacaaacagcaggcgcgtttgatccgggacgttcaggccgatggctgcggcgatcttgcccgcgtcacgaccgacccagtcacggctgacggtgcctttgccgcgttcatcgatattcttcagcagcaccggctggagctgttcggcctgagcggcggtcagtttcaccgcgtgctgaccttccatcagacgcatcagctcgtcggcgacgctatccaccacaatcagcactttttcgtcggcacagatgatgttgttatcaaacgacgcgcctttgacgatggattgtgcagcgcgcggcaggtcggcggtctcatccaccaccaccgggggattgccggcaccggcggcgatcaggcgtttattagtatgtttacgcgccgcgtccaccaccgcttcgccgccagtcaccaccagcaggccaataccgggatatttgaacaaccgctgggcggtttcgatatccgggttcgccacggtgaccagcaaattttccggaccaccggcggcgaccaccgcctgattgaggagagtgattgcccgctgagagacctttttcgccgccggatgcggggcaaacacgacgctgttgcctgcggcaatcaggctgatggcgttattaatcaccgtcgccgccggattggtggacggcgtgaccgaggccaccacgccccacggtgcattttcaatcagcgtcaggccgttatcgccggtcagcacctgcggagataaacactcgacgcccggcgtgccgcgcgcctgcgccacgtttttggcaaatttatcgtcaacgcgtcccatgccggtttcgctgacggcaagttccgctaattctcgggcgtgtttttcgcccgcttcgcgaatggcatgaatggcaagctggcgcatcgccacgctcttcagcccctgctgggcccgttttgctgccgccactgcgtcatccagggaggcaaaaacgcccatctcatgaacagtactggccggctggctgctgtctttcattttcagcagtaccgctttcaccacctgttcaatatcctgttgattcatgatgttcaatcctatttatggaaaaccactttcccgccagccaccacttcatcgacgatgccaatgacgcacagatcgaccggtgataattcgctgcgatgcgcctggcgtgcggaactgccgctgaccagcagtacccactctccggttcccgccccgatactgtcgatagcgacggcacactgcccgtcggggttgccctgggcatcgatcatttccaccatcagcaatttgtcatgcgccagtccctgatggcggacggtacatacgatttgtcctgtgacgactgccagtttcatatccgcctccatggattgcccgttgggtcgtaggccttgaatctgcgcaccatcaggcaatggcgcgcattcatgccggatggcgacgctgcgcgtcttatccggcctaccatcaaatgttgctgtcgcctttgaagctgatcgggaacacttcttccagatcgccgtgcgggcgtggaatcacgtgtacggagaccaactcgccaatgcgctgcgccgcagcggcgccagcatcggttgcggctttgcacgccgccacatcgccacgcaccatggcagtacacaggccaccgccaatctgcttcacgccgaccagcttcacgcgcgcggcttttaccatcgcatcggaggcctcaatcagcgcaaccaggccccgggtttcaatcattcctaatgcttccatcgtgttttcctctcattaaaggggtccagaacgggaccgttcattcaaccagtgtgtgtaagctgcgttcgcggctcacgtcagcctggcgcggcacggctgccaccaacgccagttcgataatttcctgcacgctacagcctcgggagaggtcgtgaagcggcgcggcaagcccctgaattagcggcccaacagcgcgatagcctcccagacgctgagtgattttgtagccaatattgcccgcctccagcgacgggaaaatcatcacgttggcgcggccttgcagcgggctgtcaggcgctttttgcgcggcgacctccggcacgaaagcggcgtcaaactgcaattcaccgtccacaagcagttgcggcgcacgttcgcgaacgagctctgtcgcctgctgcacgttggcaacattggggtgacgggcgctgccgttgcttgaaaatgacagcatcgccacgcgcggctcttcgccggtaatggcccgccaggtgtcggcgctggcgagagcgatatccgccagctgcgccgccgtcggctgcggcactacgctgcaatcggcgaaccctaatgccggaccggcatactgcggcagcatcaggaaaatagacgacaatgttttgcacccgggttgcaggccaatcacccgcagccctgcgcgcagcacgttcgccgttgacgacaggttgcctgcgatacacacatcagcctcaccggcgctcaccatggcggcagcgaacatcagcggatcgctaagcttttccactgcgtccggcggcgttttttctccggcacgggcaagccagcgttgcgcaaaacgctggcgcatactcaggttgctgtgtgggtcgatgacctgaatgccatccatcgccatacgatgactcagggcaaactgacgcagcgcaaacggactggcgaccagaacggggcgagccagaccgtactgttgcaggtaatgcgccgctttcagcacgcgttcgtccagcgcatcaggaaagacgactctggcgggggcgcgtaccgccagttcgcgggcgcgttcaatgatcatggcttctctcccaaccgttgttgaatttgggcgaccgtcagcggatgtttcgccacgctcaaaatcatcatcacgtaaaccgtactggagagacggttcagcgcctgtaaaatgtccgggcgcaagacctcaaaactacgggtaataaacacttgtgcggcgagggtttctgtttcgcggactttggttcgcagcagattaagcagcgccgcatcgcgaccgtggctggcctccggcaccaggtgatcgtggtcgaggtagcgcagcggctggtgggaaaggcgatgcagctcatcctcgttcagtccgacgatagactgcgccgccagcggttcatctatagcgtcggcgcgcataatgttgcccagccgcgagcggatatcgaaaagccacggctgccagggttccgccagttcgatttgtagccacacggtcagcgcgatggcgctgtcgagcgcggcgcgaaagccgaggcgcgggtcgcttttggcgaccattttgtccgccgtcagatgggtcagcgtatcgggctttttcaccaccggctggcggcacagttcacagcaggcctgtgggtgcgtatcgctactggttaagccatgtaccggctgcggctgctgttcgtcatcatcgacaaacagccggccttgcggatccagaaacttaatgcgcagacggcgactttccagcagttcccgggccgagggcgtcagtcgtgcgtcagcgggcagatggatctccgatccttcgctgagcgtatgattcgctctgagccacgtttcggtgatgaaatcgttcatacggattgccagtttgcaggccaggcgacgtacagaaagcgcacggacgttggcgtgccaaattcaatgctggagcctttagggatgaacatcacatctccggctttggcaatcatggtttcgccttcatggcgtacgtgcagttcgccttccagcaccatgtcgatttcgtcgtagttcagcgtccacgggaaaaaggcgttgtcccactgcataaacccggcggccatgctgctaccatcctgctctgtaaccagatcggttaagccgacgcagtgcggttcggcgccgtcgaagcggccaaatttcacgctgctgccgtcaatgactttcacgccgcctttacccgtgacggaggtaaagctcggctgcatcgtccccagttccagcgactgcttttccttcagcactttttccatcaactgcgccaccaggctttcagtaaactgcccttccgggagctgcgcgatgatggcttcccgaatgcgctggctttcgcttttacacgcctgcgccgatgtggatgccggaacggactcgtcgcattcggtaatcgtgaagcccagtagttccgccacttcgcgagcctccggggtaataatgctggcgcgcagcactaccgacatcgcctgttcgccgcgggcgtgggccgcacgaatatcgttagctgtgataagttttttcacctgcctcttcctcctgttcactgagagccgccagataatccaccaactgccgcacgctttgcgggtcgtggccgttgagctcgaaaatcggctcccggaatccaatctcgcaaagcaactgccgcgtagcggcgacgtcggcatccggcatgtccgttttgctgataacggcgatatgtcgtttacgggttccaacatccaataacccggcaggtaagcgactttctttatcgtttgccgcgtggacataaatcagcgtgtccacatcctgcaacgtggtaattaaggcgtgataccaacggggatggctaaaatattcacccggcgtatcgatatcgccatgatcattaaattccacggcctgcgtttttctggcgagggaataatttccccgtaacgcgttaaaaagcgttgtttttccggcaccgaccgcgccgacaaaagcaatacgtttcattaccgccaccaattaactttttgttaactcacacagggtaaagtttaataatcgccccagcccgctgaccgtctgtaatagcgcttcttctactgcgccgacggtgccataaatcaccagcgcgccgctaaatctatcgagaaaaccgatgtgtacatccgcagccttcatcgctaaatcgccagcgatcatcgccgtttcccccggcgttaaagtcataatgccaatcgcgccagcatcgggaacgccgatctttttcgccagttcttcaccagggtgcgcaatgagatgcgccagcgtgacctgtttgcccggcacaaattcctgaataatgcgttctttattcattgctcaccgtctccactgaaactgccgtcatcgtggcaattttttgtcggagtaaataacaaaattcggcaaggtgatgtaaaaggtgaggtagatcactaagagaaagaaaataaaagtgacttctgtcgaaggtgttaacgataaatatcgtggtgcatcacattttcaggcgtcattctgaatttaagcctgttccgcaataaatactcaccgactattctttgtattactaccattgataaaaataatgcgtatcactcgatttgtgcatagtacagattcagtgaaataagtaggggtaagcgcaacaggttccagaatatccccacccgagcctttcatgccatggcgaagcccagcggcgcataaataaatatcctccggcatagccggaggtttttcagatgcgcctataaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtgttcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaagcgcaggagaacctgcgccagaagagagagtaatgcgttattaaagcggcgtggtttgcgcttcaactaccgctaacgccaccatattcacgatacggcgtacagaggcgatcggcgttaatacatgtaccggtttagacacgcccatcaggaccgggccgaccgtgacgccttcggaactggagacgcggagtaagttgtaactaatgcgagcggcttccatattcggcatcaccagaatattggcggctcccttcagcgggctatccggcatccggtcattacgaatactttccaccaacgccgcatcaccgtgcatctcaccgtcaatcatcagatcgggcgctcgttcgcgtacccgctcaagggtttcgcgcattttgctggcggacagcgaatttgaggaaccaaagttagagtgcgacaacagcgcgactttcggctcaataccaaagcggcgaacggtttccgccgccattacggcgatctccgccaactgttccggcgtgggatcttcgttaacataagtatcggcgataaaagtgttgccgcttggcagcagtaaggcgttcatcgcccctgccgtatgcacgccgtcacggtagccaaagacggctttcacgacgctgaaatgctcatggtagtcgccgatggtgccgcagatcatcgcatccgcttccccacgctgcaccatgatcgcgccaatggccgtatggttgccgatcatcgcacgctgcgcctgttcctgagttatcccgcgacgcttcatgatctggtaatactcgctccagtactctttgaagcgcggatcggattcattattcacgatctcgaaatcaacgcccgctttgatctgtagccccagtttctggatacgcatttcgatcacgctcggacgtccgatcaggatgggcttcgccagtcccagggttatcaactcctgggttgcgtgcagcacgcgcgcctcttccccttccggcagcactacgcgcttcggatctttgcgtgcctgcgagaagatcggcttcatgaacaggttggttttgtagacaaactcggtcagtttatcgatataggcatcaaagtcagcaatcgggcgcgtcgccacgccggaatccattgccgctttcgcgaccgccggagcgattttgacaattagacgcgggtcaaacggtttcggaataatgtattccggcccaaagctcaggtcctgatcgccataggccgaggccaccacttcgctctgttcggcgtgcgccagctcggcaatcgcacggaccgccgccagtttcatctcttcgttgatcgccgtcgcgccgacgtccagtgcgccgcggaagataaacgggaagcacaatacgttgttcacctggttcggatagtcggaacgaccggtacagatgatggcgtccggacgcacttctttcgccagcggcggcagaatttccggttccgggttggccagcgccagaatcattggcgcgcgggccattttcttcaccatctcctgagtcagcactttcgggcctgaacagccgaggaaaatatccgcgccgtcaatgacctcatccagcgtgcgcttgccgctgtcgtctaccgcataggccgctttggtctccgccatattcggctcacggcctttgtaaataacgcccttagagtcgcacaccacgatgttgtgcttttgcatccccaacgcgaccagcaggttcatacaagcgattgccgccgcccctgcgccggagacgaccatccgtacgtcggaaatatttttctctacgactcgcagaccattaagaatggcggccgtactgatgatcgccgttccgtgctgatcgtcatggaaaaccgggatgttcatgcgctcgcgcagtttctgttcaatatagaaacattccggcgctttaatgtcttcgaggttaatgccgccaaaggtcggctccagcgctgcgaccacattgataaatttgtccggatcaagctcatcgacttcaatgtcaaacacatcgatgccggcgaattttttaaacagaacgcctttgccttccatgaccggcttgccggccagcgcgccaatgttgcctaaccccagtaccgctgtaccgttggaaatgaccgcgacaaggttgccgcgcgcggtgtatttgtaggctgccagcggatctttttcgatttccaggcagggcgccgccacgcctggcgagtaagccaacgccagatcgcgttgggtggcaaggggcttagtcggagaaacctgaattttaccgggtaccggaaattcgtggaaatcaagggcgctttgttttaactgctcatccatcttgttgttcctttcacgtatcgttcaaaaagtgacgcggcctggtgcgccgcacattatcaccgtactgcgcaacacaaactttgaaggtctgcaaactatcacgacgcagcgcaagagtttgttatcaacttataacggtcatgttacctgcttataccagcaataccatgcctgtctgctatgctttttggttatgtagtgtatcaatctttcagaagtgtgaatcaacacactcatctaacactttacttttcaaggagtatttcctatgaaccagctagacggcatcaaacaattcactaccgtcgtcgccgatagcggcgacatcgagtccatccgccactaccagccgcaggatgccacgacaaatccctctttactgttaaaagccgccgggcttgagcagtatggtcatttgattgaggatgcgattgcctgggggaaaaaacacggcggtacgcaggaacagcaggttgcggcagccagcgataaactggcggttaattttggcgcggaaatactgaaaagtattcccggtcgcgtctccactgaagtcgacgcgcggttatcgttcgataaagaaaaaagtatcgagaaagcgcgccatctggtggatctctaccagcagcagggtgttgataaatcacgcattctgatcaagctcgccgcgacctgggaaggtatccgcgccgccgggcagctcgaaaaagagggtattaattgcaacctgacgttgttgttctcttttgcccaggcgcgcgcctgcgccgaagcgggcgtctatttgatctctccgttcgtgggccgaatttacgactggtatcaggcgcgtagtccgctggagccgtatgtcgtggaggaagatcccggcgtgaaatcggtacgcaatatctacgattactttaaacagcatcgctatgaaaccatcgtgatgggggcaagtttccgccgtactgagcaaatcctcgcgctaaccggctgcgatcgactgactatctcccctaacctgcttaaagagctgaaagaaaaagaagaaccggtgatccgtaaactggtgccttcctcgcagatgttccaccgtcctacgccaatgacggaagcggagttccgctgggaacataatcaggacgcgatggccgtagagaagctgtcggaaggtatccgtctttttgccgttgaccagcgcaaactggaagacctgcttgccgccaaactataaaccttgcatggagtgatttatgtcccgtaaagaccttgccaatgcgattcgtgcgctgagcatggatgccgttcaaaaagccaattccgggcaccccggcgcgccgatggggatggcggatatcgctgaagtgctatggaacgattttcttaaacataaccccaccgatccgacctggtatgaccgtgatcgttttatcctttccaacggtcacgcctccatgctgctctatagtctgctgcatttaaccgggtatgacctgccgctggaggagttaaaaaacttccgtcaactgcactctaaaacgccaggtcacccggagattggctatacgcccggcgttgaaaccaccaccggaccgctgggccaggggctggcgaatgccgtcgggctggcgattgccgagcgtacgttaggcgcacagttcaaccggccggaccatgagattgtcgaccactacacctatgtctttatgggcgacggctgtctgatggaggggatctcgcatgaggtgtgttcgctggctggtacgctgggactgggcaaactgatcggcttttacgatcacaacggcatctccattgatggcgaaaccgaaggctggtttaccgacgataccgccaaacgttttgaagcctaccactggcatgtcgtacatgacattgacgggcacgatccggaggcggtgaaaaaagccattctcgaagcccagagcgtaaaagataaaccttcgctaattatctgtcggacggtgataggttttggctcgccgaataaagccgggaaggaggagtcgcacggcgcggcgctgggcgaagaagaggtggcgctgacccgccagaagctgggatggcatcatccggcgtttgagatcccaaaagaaatttaccgcgcgtgggatggccgtgaaaaaggcgagaaagcgcagcagcagtggcaggaaaagtttgctgcttatgagaaggcttatcctgagctggccgcggagtttacccgccggatgagcggcggactgccggaggcatgggaatccgccacgcaaaaatttattaacgacttgcaggctaatccggccaaaatcgccacccgtaaagcatcgcaaaatacgctcaatgcctacggtcccctgttgccggaactgttgggcggatcggcagatctggcgccgagcaacctgactatctggaaaggttcgacctcgttgaaagaggatccggcaggtaattatatccactatggcgtgcgcgaattcggcatgaccgccattgctaacggcatcgcccaccacggcggctttgtaccgtataccgccacgtttctgatgtttgtcgaatatgcgcgtaacgcggcgcgtatggcggccttaatgaaagcccggcagattatggtctatacccacgactccatcggtttgggcgaagatggcccgacgcaccaggccgtggaacaactggcgagcctgcgcttaacgcctaacttcagcacctggcgtccctgcgatcaggttgaggcggcagtcggctggaagctggccattgaacgtcagcacgggccgacggcgctgattctctcgcggcagaatctggcgcaggtggaacgcacgccggaacaggtgaaagcgattgcccgcggcggttatattctgaaagatagcggcggcaagccggatatcattctgatcgctaccggatcggaaatggaaattaccctacaggcggcggaaaaattgactggcgaggggcataacgttcgcgtggtgtcgttgccttcaacggatattttcgatgcgcaggacgaggcatatcgcgaatcagtgctaccggcacacgtaaccgcccgcgtcgcggtggaggccggtatagccgactactggtataaatatgttggcctaaaaggcgcaattatcggcatgacgggatacggtgaatccgctccggctgacaaactgttcccgtattttggctttaccgtggaaaatattgtagaaaaagcccgccgggtgctaaacatcaaaggctaaggcgagcgttagcaacacagactttgcacagtctgcagacctgttctgtaggctgtgcaaaattacttcgtagactcaggcgcatctgactgcccgatgacgacctcatcaatggatttatggcacatcaggcaaaaggccttttttttatgcgcctgcaatgttgaatcccacgccgctgatccgccttctttattcactttttctcttatcgccgccagccgatctatttcataataagcgctcaggcagccacaatgggggcataatacggggccattatttattttcatactatttcctgctgtggtgaggctatcgggtaaagtaacaatcctaccgtaacgtagcaatctctataccataaatgaaacctcaataggtgtatccctattctgaaaaggggataacaaccaggattcaacgcgtgatccacagcgtaggccaggcatccggcccgtgccagctatcgcagctcggttcttcggcataacgcaccagacgaaaacgatcgccatcataacgccagcgcgtctggataccgcagtcggttaacccccgccctttcgccaacgtcaccagctcgcgcgttttctcgtcaaagaagacgttcatcaactccatgtcattactttcgacgccgcgattaaacggcagccgcaaacgtacggcgcgcgagacgagcgtttttttgcgtgaaactacccaggcgagatcaatagtgttataggcgccggcttcgcagttaacaatcaataacgctttatcatccgtcaacgcgctgacctgcgtctcgcgacgcagcgggtcaagcgaacaacgaatgccgtttacccgccatgctgcgtagtccagcagatcgtcgcgttcttcctcactcagcggtacgggcgttggattaatcacggcgatcccctttaatgccggtgccgggggcacgctgagcggcggttcgtttcctttttcaatccaggcggtttcgctgcccacacgtttttgttgcgcgtcgataaacagtaatgccgcttttaatcccgccagcgaaagcgtctgaacgccgttttttaaggtgatggcctgcgcatcctgaatcgtctgtaaaaatgcggtgatggtggcaggatcgccggtcatgagatgccagggcgacacgcgccagtgtggactgttgaacgaaagcggtttgccatccagcaataagcgaggcgcaattgcggcttctttagcgtcgggcggcgccaaaccgccgcggtcgatacgcagtaccgcatcggtacgcgccccggcgctgcggcttaatgtcatcaccagcccatgatgttcgccagtattgcgcgctacgcaaaaattttggttattgcaggtgacctgccagtcggaaaaagtccgttgcgctggcgcagcccacagtagctggaccggcaacaggccaaacagacaaaaaagaataacgcggtagcgcatgaacggaacaaccccagattcagaacaacacagctaaggcggtatcttccttgcgcgcctcagggttctcaatcagatttatcggattggtcttttttgtgtaaagaaatatatttcttttttttcagtccattagatgagacgtctgtaaatagttaagcaataacacggtcttaccgtcccgaatctcgcctgagcgcaccatttccagcgcccgggaaaacggtagttcaagcacctcaatctcttcgtcctccacgccgccgccgatgctggcacgctcgctatcatgatattcggcaatgaagaaatgaatcagctccgtgacgccgcctggcgacatataaagctcaaatatcttgcgtacctcaccaacgtcataccctgtctcttcaatggcctctttacggatacagacctccggctcgtcgttatcaagcaggccagcgcaggtttcaattaacataccgtcttgattaccgttgacccatgtcgccacgcgaaactggcgaaccagaaccacggtttttttagttgagttgtaaagcagaatggttgcgccattcccgcgatcgtaaacctcacgcttgtgacggataacctcgccattacgacgggtcaggtcataggtaatgttgcgcagagtaaaataattatcagaaagaattttatccttaataagcgtaatggtttgcgacatgctggctccagggtgtaaaaagagcattaatattacgccgtgaggtcggttttgtctgctgaagggttaatccttaatgccgactgaacggacgtacagccatatttttctgtcactgccatgaccatattctgcttctccgggccgcagagtccatgctcgcgatatgatttgacggccggagtgagactgagggaatcatcatgaaatttactctcgttgcgacggttctactgacgttttccctttcagcttttgccgttgagtatcctgtattgaccaccgcgagccctgatcaggtggggtttgatagccaaaaacttcaccgacttgatggctggattcaaaatcaaattgatgccggatatcccagcatcaatcttctggtgataaaagataatcatattgttctacaaaaagcctggggctatgccaaaaaatatgacggttccacgctgttagcccatcccattcgggcgaccactaacacgatgtatgatctggcttcaaacacaaaaatgtatgccactaacttcgcattgcaaaaactagtgtatgaaggaaaaatagatgtcaatgatttggtatcaaaatatatccccggctttaaggatatgcctggggataaaataaaaggcaaaaataaactccgcattattgatattcttcatcacgtcgcgggctttcctgccgacccacaatatcctaataaaaacgtcgccggtaaattattctcacagagtaaaagcactactctggagatgattaaaaagacaccgctggaatatcaacctgggtcgaagcatatctacagcgacgtggattatatgattcttggttttatcattgaatcgataacggcaatgccattagatcgctacgtcgaaaccaccatttataaaccgctcggattaaaacataccgtctttaacccgctgatgaaaggcttcacgccgccgcaaatcgccgcaacggaactacatggcaacacgcgtgacggcgtgattcatttccccaatattcgcaccaatacactatggggccaggtgcatgatgaaaaagcctggtactcaatgggcggcgtttcaggacacgccggactgttttctgacacccatgatatggctgtgttaatgcaagtcatgctcaatgggggcggctacggtaacgtgaagctattcgacgacaaaacggttgcgcagtttactcgccgctcgccagaagacgctacctttggtctggggtggcgcgttaacggcaacgcctcaatgacccccacgttcggggtattagccagtccgcaaacgtatggacataccggatggaccggaacgctgacgtctatcgatccggttaatcatatggcgattgtgattttaggtaacaggccgcactcgccggtagcaaatcctaaagtgaatccgaatgtttttgtcagtggattattacctgcggcgacgtatggctggattgttgaccagatatatggttccttaaaataaaaattaagagcctatctctgtaggcgttattggcgcagccagtttggacacggacagcgcgcaaaaaccggagcgtacacgtagtacgtgaggtttgactcgctacgctcgcccttcgggccgccgcaagcggcgttcaaaacgctaacgcgttttggcgagcactgcccaggaccaaaatggcaagtaaaatagccctaatgggataggctctaagaaggggttctgatagcgtcccttccttcaatttacactctattttcaatactaagattgtcctcatcaggcctgttaaacgtcgccccgacgggaaaatgtttatcgcagggcgttcagccctgcgagcgtcaacatttctgcaaacggagtaaggttagccaataagtttaagattttttatcactcaatcatttaaccgttccaggccttaaccggcctacaaatacgcttatttagctaaccagtcgagtatcccctgcgcagcatgtcggccttctgccatcgccgtcaccaccagatcggcgccgcgcaccgcatcgccgccggcgaaaattttcgggttggacgtctggtaacgaaactcgctctcgacgctggcggcaatacgtccccagttatccaccttcacgccatgcgattccagccacgacataccatgcggatgaaaaccaaacgccataatgaccgcatccgccggcatcacgaactcgctgtccggtacaggtaccgggcggcgtcgcccctgaccatccggttcgccaagccgcgtacgcaaaaagcgaataccgctggcgcgcccgtgcgtatccagcaccaactcaaccggctgaacgttaaattcaaagttcgcgccctcttcccgcgcgtttttcacctcttttttcgaccctggcatattggcctcatcgcggcgataagcgcaggtgacgttagcagcgccatgacgcagcgccgtacgtacgcagtccattgcggtgtcaccgccgcccagcacaaccacgttaaggcccgcagtatcaataaacggctcgtcaggcaacgccggaagccccatcacctgtttggtattggcgatgaggaatggcaacgcatcatatacccccggcgcatcttcattcggtaaatcagccttcatggaacgataggttccaaccccaacaaagacggcgtcataactctccagcagcgtctccagagaaatatctttccctacttcgcagttaagctcgaaacgaatccccatcgcgctgaagatttcccgacggcgcgccagcagagatttatccagtttgaaagccggaataccaaaggtgagtaaaccgccgatttccggatggcgatcgtagacggtggcgcttacgccatggcgcgccagcacgtcagcgcaggcaagacctgccggccccgcgccgataatcgccacgcgcttatcgctcttctgtacgtccgacaggtcgggacgccagcctttgctcagagcgcgatcggagatatagcgctcaatattgccgatggtaaccgcgccatactcatcgcggagtgtacacgcgccttcgcatagccgatcctgcggacagacgcgcccggtaatttccggcagacagttggtctggtgggaaagctctaccgccgcatcaatatcgccggctttcaccagttcgatccactggggaatatggttatgcagcggacaggtccattcgcagatactgtgttccccgcatgtgaggcagcgggacgcctcacgctccgcctgcgcggcgcgaaacggcagataaatttcctcaaaggtggttttacgcgcttcaatcgccagtttatccggttcgccgcgcggcggcgtcgcctgcatacgctcggctttgctgcttgctgccccactgtgttgtgtatccacggtatgccaggggcgaatctcctgccgggcggtacgcagccgtcgcgttttagccagacgggtcaacgagtcttcggtgaccagttgcagcgcatccgccgggcaattttccacacaggccggcccctgttcacgtccctgacacagatcgcatttatgcgcgctggctttgaactggtttggcgcgacgggcgtcaataccatctgcatggtgccgaatggacaggcgacgacgcaggatttacagccgatgcacttctgcgcattgacctgcacgctgtcgttaatatgcgcgatcgcgccgttcggacagctacgggcgcagggcgcatcttcgcaatggtgacatgtaaccgcgctgcgctggtgctgatgtttaatgacagtaattcggggctgatagcgctgtgacgtcaggacatgtcgctcatcattgtgagccattacgcaggcgacctcgcaggcatggcagcccagacactgctggctattggccataataaaacgattcatggcgtccttctgttttggttgcaaaaaccttattctttatatgagcattgttattaactgacgaaggcggggtcggcaatgttcatctgcccaggaagcacaactatctgtccagaacctgtggcagatcaatttatttcaaagcaaatgaaattgcggttcagctaaatgcggggagtaccagtgtgacggttaaacgcccggtctcggccagtctggctaaggcttttttctatattgtgctgttgtctattctgtccaccggcagcgcattactgacgctgaccagcagtttacgggatgccgaagcgatcaatatcgccggttcgctacgaatgcagagctatcggctgggttacgatctgcaaagccgtagcccgcagattaatgcgcatcgtcaacttttccagcacgcgctcaactcgccggtactgcaaaatctcaacgcctggtatgtgccgcaggcggtaaaaactcgctacgagcgcctgcacgccaactggctggagatgaatagccgcctacaggacggcgacattgcctggtatcagaccaatatcaacaattacgtcaatcaaattgatctcttcgttctggcgttacagcattacgccgagcgtaaagtcatgctggtcgtcgccatatcgctggcgggcggtatcggcatatttacgctggtcttttttaccctacgacgtattcgccagcaggtcgttcgcccgctgaatcaactggtcaccgccagtcagcgaattgaacatggtcagttcgccccgctgccgctggataccagcttacccaatgagctgggattgttggcgaaaacgtttagccagatgtcgagcgagctgcataaactttatcgttcgctggaagcctcggtggaagaaaaaacgcacgatctgcacgaagcgcaccgccgcctggaggtgttataccagtgctctcaggcgctgaataccagccaaatcgacgtccactgttttcgccatattttgcaaattgtccgtgaacatgacgccgcttggtatctggagttaaccgtgggcgataactggcggattagcgaaggcacgcaaagccccgacctgccgatgcaaatgctgccagtgacgatgcaggacacggtctatggcgaactccactggcaaagccccaacgttaatgcctctacgccgctgctgaacagcgtctccacgatgctggggcgtggtttgtactttaatcaggcgcaaaaacacttccagcaacttttgttaatggaagagcgcgcgacgattgcccgtgagctacacgattcgctggcgcaggtactttcttatttacgtattcagttaacgcttttgaagcgcgctattcctgaggataacgccggcgcgcaaagcatcatggcggatttttccagagcgctgaacgacgcctaccgtcagcttcgcgagctactcaccacgttccgtctgacgttacagcaggccgatttaccctccgcattgcatgagatgctggaagatttacagagtcagaccccggccaaactcacgttggattgccgtttacccacgctggcgctggatgcgcaaatgcaggtgcatttgttgcaaattgtgcgtgaagcggtcctgaacgccattaaacacgccaacgcgagcgaaatcgccgtgagctgcgtcaccgcgcctgacggcgatcataccgtttatattcgcgataatggcattggtatcggcgaaccgcatgagcctgccggacactatggtctgaatataatgcgtgagcgcgcggagcgccttggcggcacgctgaatttttcgcaaccctccggcggcggcacactggtcagtatcagttttcgctcctccaacaaggaagagagtcagttaacgtaaagaacggcaaatcgccggaaggccagatgtcaggctttccggcgttggcacaaaaagtatgctgtaaaagcgcatgataatttacattatctcctttatttctccacgtttggctcgtagcttgccgctacagtgaagcagttcaaatctataacgatatgtagaaacacgaggtttccctttaatggcgaatttttttatcgatcgccccatttttgcctgggtgctggctatcctgttgtgtctgacaggggcgttagccattttctctttacctgttgaacaatatcccgatctggcgccgcccaacgtacgtattaccgcgaattatccgggagcgtcggcgcaaacgctggaaaataccgtaacccaggttattgagcagaatatgacgggcctcgataatctgatgtacatgtcatcacaaagcagcggaaccggacaggcgaccatcaccctgagctttattgcgggaaccgatcctgatgaggcggttcagcaggtgcaaaaccagttacagtccgcgatgcgtaaactgccgcaggcggtacaggatcaaggcgtcacggtacgcaaaacgggcgataccaatattttgaccatcgctttcgtctctaccgacggttctatggacaagcaggatatcgccgactacgtcgccagtaatattcaggacccgctcagccgcgtcaacggcgtcggcgatattgacgcttatggttcacagtactctatgcgtatctggctcgatccggccaaattgaatagttttcagatgaccacgaaagacgtgaccgatgcaattgagtcgcagaatgcgcaaatcgccgtcgggcagcttggcggtacgccttcggtcgacaaacaggcgctgaacgccaccattaatgcgcagtcattgctgcaaacgccgcaacaatttcgcgatatcaccctgcgcgttaatcaggacggttccgaggtcaaactgggcgatgtcgccaccgtggagctgggggcggaaaagtatgactacctcagccgttttaacggcaatccggcttccggtcttggcgttaagctggcctccggcgcgaacgaaatggcgaccgcgaagctggtactggatcgcctcaacgagctggcgcagtacttccctcacggcctggaatacaagatcgcgtatgaaaccacctcctttgtcaaagcctcgattatcgatgtggtcaaaacgttgctggaagctatcgcgctggttttcctggtgatgtatctgttcctgcaaaactttcgcgccacgctcattccgacgatcgccgtgccggtagtattaatgggcaccttctccgtgctttacgcgtttggctacagtattaacacattaaccatgttcgcgatggtgctggcgatcgggctcctagtcgacgatgccatcgtggtggtggaaaacgtcgaacgtatcatgagcgaagaagggctcacgccgcgtgaagcgacgcgcaaatccatgggacaaatccagggggcgctggtcggtatcgcgatggtgctgtctgcggtattcgtgccgatggcgttctttggcggtaccaccggggcgatttatcgtcagttttctattaccattgtctcggcaatggtgctgtcggtgctggtcgccatgatcctgacgccggcgctgtgcgcaacgttattaaaaccgctgcacaaaggcgaacagcacgggcaacgcggatttttcggctggtttaaccgtaccttcaatcgtaatgccgaacgttatgagaaaggcgtagcgaaaattttgcatcgcagcctgcgctggattctgatttatgttctgttacttggcggaatggtgttcctgtttttgcgcctccccacctcctttctgccgcaggaagatcggggcatgttcactacgtctatccagctaccgagcggttctacgcaacagcagaccctgaaagtcgttgaaaaggttgaaaactattacttcacccatgagaaagacaacattatgtcggtcttctcgacggtaggttccggccctggcgggaatgggcaaaacgtcgcgcgcatgtttgttcgcttgaaagactgggacgcgcgcgatcccaccaccggctcctcgttcgccattattgagcgggcgacaaaagcatttaaccagattaaagaagctcgcgtcttcgccagcagcccgccggcaattagcggtctgggcagctccgccggttttgatatggaattacaggatcacgccggagcaggccatgacgcgctgatggccgcacgagatcaactcattgagctggccgggaaaaacagttccttgacccgcgtgcgccacaacggcctggacgacagcccgcaactgcaaattgatattgaccaacgaaaagcgcaggcgctgggcgtatcgattgacgatatcaacgacaccctgcaaacagcctggggatcgagctacgtcaacgactttatggaccggggccgcgtgaagaaggtctatgttcaggccgcagcgaaatatcgtatgttgccggatgatattaatctttggtatgtccgtaacaaagacggcggcatggtccccttctccgccttcgccacctcgcgctgggaaaccggatcgccgcgtctggaacgctataacggctattcggcggtagaaattgtcggagaggccgcgccgggggtcagtaccgggacggcaatggatgtcatggagtcgttggtgcatcagctaccgggcggttttggcctggaatggacagccatgtcttaccaggaacggctctccggcgcgcaggcgcccgcgctgtacgctatttcgctattagtcgtcttcctgtgtctggcggcattgtatgaaagctggtcggtgcccttctcggtgatgctggttgtgccgctcggggtcatcggcgcgctactcgctacctggatgcgcgggctggaaaacgatgtttacttccaggtggggctgttgaccgttatcggcctctcggcgaaaaacgcgattctgattgtggaattcgccaacgaaatgaatcagaagggacacgcgctgttagacgccacgctgtacgccagccgccaacgcctgcgaccgatactgatgacttcgctggcgtttatctttggcgtattgccgatggccaccagcaccggggcaggctcgggtagccaacatgctgtcggaaccggcgtgatggggggaatgatctcagcaaccgttctggctatcttctttgtacccctgtttttcgtgctgatacgtcgccgcttcccgctgaagccgcgcccgaaataagatcccggccagcctgatacgaggtgtcgggcacaaaaaaggcgactttcgttgagtcgccttttcttatcccctatgggagcgcggtgccttccaggcatttatttacgaagcatgacttcgataaaatctttccagttccccagttcacgttcaatcataatagcctctcttattattatgggtattctacgtagttagcggtatagagagaagttcatttaaccgattgttgcgatatcctctggttatgctgtctatgatattactatggcgctgtagccataaattttatgtgacttactgcaatatttagcaacattaataccttttctactactttatcaaattgggttaaaaaacaaacaattgcatatgcacaaaataggatttataccgcgaagtataaacaagccacatctggaacgttttggaatcattattcacattcactcaacaatgttatattgattgccgatcagcgctggataaataaccataaacggccacacttattatcccgcagacgatactattgattatttattcgaatttcgcgttaaaggattcaatatgattaccctctatggcattaagaattgcgacacgatcaaaaaagcgcgccattggctggaggaacatggcattgattatcgttttcacgattaccgtgtggatggcatagacctccctcttcttaatacctttattgccgaactcggctggcagcctttactgaatacgcgcggcacaacatggcgcaaactggatgaaggccaccgcagcgggattaccgatgccgactccgccgctgctctcatggttgaacagccggcaatcatcaaacgcccattgctctgcgcgcccgggaagcctatgctgcttggtttcagtgaatcccgttatcagcagttttttgatgaggtgtagtctatgtcgtgcccggttattgagctgacacagcaacttattcgtcgcccctccctgagtccggatgacgcaggctgtcaggcattaatgattgaacgcctgcgtaaaatcggttttaccattgagcatatggattttggcgacacgcaaaatttttgggcatggcgtgggcgtggcgaaacgctggcgttcgccgggcatactgacgtcgtaccggctggcgatgtcgatcgctggatcaatccgccgtttgagcctacgattcgcgacggaatgttgttcggtcgcggcgcggcggatatgaaaggttcactggcggccatggtggtggctgctgaacgttttgttgcgcagcatcctcatcaccggggccgcctcgcatttttgattacctctgatgaggaagccagcgcaaaaaatggcaccgtaaaggtggttgaagcgctgatggcccgtaacgagcggctggattactgtctggtcggcgaaccttccagtactgaaattgtgggcgatgtcgtcaaaaacgggcgtcgcggttctctcacctgtaacctcactatccatggcgttcaggggcacgtcgcctatccgcatctggcggataaccctgttcatcgcgccgcgccttttcttaatgaactggtcgctatcgagtgggatcggggcaatgactttttcccggccaccagtatgcaggtagccaatatccaggcaggcaccggcagcaataatgtcattcccggcgaactgttcgtgcagtttaacttccgtttcagcacggaactgaccgatgagatgatcaaagagcgggtacatgcgctgcttgaaaagcatcagctacgctataccgtagactggtggctttccgggcagccgttcctgaccgcacgcggcaagctggtggacgcggtggtaaacgccattgagcactataatgaaattaaaccgcaattactgacgacgggcggtacgtccgacggacgttttatcgcccgtatgggagcgcaggtggtagaactggggccggtgaacgccaccattcataaaattaatgaatgtgtgaatgccgccgatctccagctactggcccgtatgtatcaacgcattatggaacagctcgtcgcctgatgagcgttccggtaagaggaaataagcatggactggctggcaaaatattggtggattctggtattggtgtttctggtaggcgtactgctgaatgtgatcaaagatctcaaacgcatcgaccataagaaattccttgccaataaacctgagctgcccccgcatcgcgattttaacgataagtgggacgatgaagacgactggccgaagaaagatcagccgaaaaagtaaccggatatcatgccggacaggtatcgctatccggcatggtccccaccgccgggcattacgtcgcgcaaactctgcgttcgtccggcatccaacgcaattagcgcctgcgccgcctgcgcacgctgcaacgccagcagagctttacggcctgaaatgcgtagccgggcgcacagttcggcatcgctggctttttcttccagccgccctctcagcgccggtaatggcaatgcgctgtattgcagtaaacgatgcaggcaacctaacgatgtcagtagcggacggtgcgcgaacgcaaaaccgaccagctcacgccagtcttcatcattaagcgcctgttcgcgcaacgccgccagcggtatcgcctcgccgttccactgcgtcaggatatccgcatcgcggcgcaaacgccggtgttcctgctgcgccagccgttttcccgcgtcgctcagcggcaataacgccatcgccgtatagcaaccgctgctcgcctcccgatggttgcccatccgtaccagtacaaagccgcagcgttgccagaaacgccacagcttcggcgtatagccgaagctgacggaaagataatcacactgcgccgcctgcatgcacgcgcaggcaatcaactgctgaccgatgccttcacgctggcgagcggggtgcactgcgatacggcttacgcgacgcccaaccagcgtcgcggctaaagggtcgctaccgtgcgccgccagcgactgcgccaccagattcccacgcggccgccggaaaccgcaccatacagcctgactgagttctgcggataacccgccctcttcgaccagccagagggcgcccgccacacggttattcgccgtagcctgcaagaaatgctgtcctggcgcatccatcattcggcgcagatccagcggcgaagtacgatagtgcgcccccgacagtaactgatacacagccctcggcaacgcgggcgtattcacccaggcctgttggtaaaacgccgagatttctatcgcgccatgtggcgcctgcgcaaacgcttcatcgtcgaatatcagcgcctcgctgacgatattttccagcgggcattctggcgcccagcggacaggctgacgaagcgtgaagcggtgaagctgcggaaaacgggcgcaaaacttaagtaaaaaaccgcgtccggtgccttcgtagccctgaacggtggtggtgagtagtatgcggggaaagcgcgaaaccagttgcagcagcagcggcgtggggattgccgccgcctcgtcaaccaccagccagtcggctcttgccccgctcgccagcaacgcatccggcgccataaagcagaaccgctcaccggcaaacgctgccaggatatccgttgccgttttcgccggtgcggtcacgatagccgtgcccgccatccgggagatgaattgcccggccagcgccgatttgccgcgcccacggggggcaatcaccgtcgccacgccgggcggcatttcacgtaaacgcgataagatagccgcctgctccggctgcggctcgccggtggcgggtcgccagcattcacgggaaggataagatggccagcaaaacggctggcgctgtcgccaaagcagcgtttgcggatcgcgggagagagtccgtttaagatgctgtgcaaactgcggtgtggggataggctgcgcgcagtcgctccagcgcagtgaatcggtatcaggcctgctttcccacgtctcgtacggcggcatcagcagaagcagccagcttccggcctgcaaggtcccgctcagggcggcaaacgctgcggcgtcaaagccctgccaggcatcaaatatcgcatgacggaattcacggcccagcagcgtttgtaacgcctgtggcgtacagcacggctgggcgggcgcgtcaggcgcgacccacagccagtcaccgggcaatgcagcgcgtatcgcctcggcccgcttccggcaccacgccgcatcgccgctgatgaccagtaaacggcgaatgccttcctgtgtcatttgcgacgttaacgcctgtagcgcatcgatatcagacatccctgccccggtttatcaaaagtttttgccaaacgtattacattgcgccgggtcaccgctgtcaaatccacgcttaaaccagctgtagcgctgttctgaggtgccgtgagtaaaactatccggcacgacgcgcccctgcccctgttgctgtaagcgatcgtcgccgatagcctgtgcggcattgagcgcctcttccagatcgcccgcctccagtacgccttgctgctgcatactgtgtccccacacgccggcaaagcaatccgcctgtagctccatgcgcaccgaaaggcgattcacctccgtttgcgacgcgttttgctgcaactggcgtactttcggctcaatacctaacagtttttgtacgtggtggccgacttcgtgggcgatgacataaccctgggcaaaatcaccgtccgcgcccagcttatttttcatatcatcgtaaaatgagagatcgatataaacggtgccgtccgccgggcagtaaaacggccccatcacggactgacccgcaccacagccggtgcgcgtcataccacggtacatcaccagttttggctgctgatagccgcgccccattttttgaaagagttgaccccaggtatcttcggtcgtcgccagaatcaccgaggtaaattttgccgcttcatcatcattggggcttatcgaacgcgtcgactgctgctgcgaaaccggctggccggtcaacagaccggttaaatccaccccatagtaccctgcgaccaacaccaccaccaacagaatgatgccgccttttccgcgcggaagacgaaagcctgggccacccagcgaggggccgcctggccgattacgtctgtcctctacattgttgctttcacgacgcccttgccagcgcataatcacctcattctctctttgttatacagatgatcgtaggcggtcaggcgcaggattaccacaggtaaacgctatcagaatgaggaaaggatgataccggagagcggttgccccccggtcagaagcggaattaatctaatttcacgcccaggcgatgcgcgacggcttcataggcttcaatcagaccgcccaggctctggcggaagcggtctttgtccattttgtccagcgtctctttatcccacaggcggctaccgtccggcgaaaactcatcgcccagcaccacttcgcctttatacaggccaaactccagtttgaaatccaccaggataagacccgcgtcatcaaacagttttttcagtacgtcgttggctttgtaggttagctctttcatacgcgccagattttcctgacttacccaaccgaacgtttcacagtaggaactattcaccatcgggtcgtgcagcgcgtcgtttttcaggaacagatcgaatatcggcgggttaagctccatgccttcttccacgcccagacgcttgaccagcgacccagccgcacggttgcgcaccacacattcaaccggcaccatctccagcttcttcaccagacactcggtatcagacagcaaacgttccatctgggtcgggatgcccgcctcggccagtttggtcataatgaaatggttgaatttgttatttaccatgcccttgcgatcaaactgttcaatgcgcgcgccatcccctgctgacgtatcattgcggaattcgagcaccaacaggtccgggttttccgtgctgtatacggttttcgctttaccacgatacaactcagcttgcttttgcatctttaacactcctgggtgtgaattaacgataagtattcatttcctgctacgcctgccggagacgccggcctgtaattgtggtgcgaaatagcggttaaatcgcgtttttgtaccgacgcacacgtttgcgtatcttatcagaaaaaagggccggattgctccagccctgttaaattacttgttgaacgctgcctggaagacggcaaccagcgcgtcgttctggctttgcgtcagagtatgccccttaggatcgataaactgcaagctgctgcggttatctaaatcgccaacctgcaatttatagtctccggatgccaggcccgggtcgctagcgcccagatcccgccagtcgctgtcagacaacggtttgtacgttaccgccatgctgccctgagagcgagtgctgtcggtgactttcatgcccactttttccagcgcggccgggaggcgctgccacacgaggttgaacggaccgcgaacgaccagcataggtaaaccggtatcatcagcggcgctctgcacatccatcgttgcggcggaacggttctgcgcggcatttgccgcatccgtagcggtcttatccagaccggcggaaatgacgttcatcatttccgtgctatagcgctgcagcgacgccgcgtcagcgaccggcttgccagcctgttccagattaaccagttttaccgttaccgcctgctgatagccctgcggcttcaccgagatttgataacgtccacgatactgttcgtcttcatccaggcgattccagttcacccaatcggtcgtcagggtctggctggcatcgtcacgtttttcaatcggataatttttcgcctgaatcacgctgacgacttgcggccacagcgtgctgctccggccattttccaccaatagcgtagcggtatcgccagagaactgggtacgcgcgccgctcactaacgctaacggctgcgccggcggacggatatccaacgccttaccaaccgcgccgctccccttcgtgaccggaataacgtagtcgccggtcgttatcggcaggatcattcctgccggggcgtgaagttcagcaagcggcgcggcatccagataggattcatcgccgcttacctggcgcttgtagcgcgaatcggaactacaggcagcgagcagcaaaacaagcgaaacacccgcaaccttcgccaggcgcgacttttgtactgagtaagccatcaaatctccctaaactttacagcaggccagcatgctgaagcgctgctttgacgatgtcacgaccatggtccgtgataggcgtcattggcaggcgcagcgtgtcggtcgccacaagacccaatgccttacatgcccatttcaccgggataggattgggttcgacaaatagtttgttgtgtaacggcatcagacgctggttgatagcgcgcgcctcggcaaattgcccttccgccgccagtttgcacatgtcagccatctcgcgcgccgctacgttagccgtaacggaaatcacgccatgaccacccagttgcataaagtccagcgcagacgcgtcatcgccgctaagcagaataaaatcgtctgaaaccagctctttgatctggtgaacgcgggttaagttccctgtcgcctctttgatagcgataatattttttatttccgccagacgacccacggtttccggcaacatatcgcaaccggtacgggacggcacattatacagaatttgcggcaagtcagtgtgttccgcgatggctttgaaatgctggaacaaaccttcctgcgtggggcgattgtagtacggcgttaccgtcaggcagcctacaataccgctatcgttaaaacgctgcgtcaggctaatcgcttccgcggtcgcgtttgcgcccgtgccggcgataaccggaatacgtccgtcagccagttccagcgtcatcatcacgacatcgccatgttcatcatggcttagcgtggcagactcgccggtagtgccaaccgaaacaatcgccgaggtaccgttggcgacatgataatcaatgagttttttcaggcaagacctactgacgttacctttctcatccatcggcgtaacaagcgcgacaatacttcccgtgaacatgggccatcctctgtgcaaacaagtccctcaatggtacgtttggtatggcaataaaagcaagcgaccaaagccgttctgattgttgtatgcaggttttttttatggtttccttaagattacctcaccgctcaaaggaataactggtttgacaccgtcatcacaacactatttggttatcactgcgctgggcgccgacaggcccggtattgtgaataccattactcgccatgtcagcagttgcggctgtaatatcgaagacagccgactggcgatgctgggcgatgaattcacgtttattatgctgttgtccggcacgtggaacgcgattaccttgattgaatcgacattgccgttaaaaggcgcggagctggatctgctgattgtgatgaaacggacgtccgaccgcccccgcccggcaatgcccgcgacggtatgggttcaggttgaggtcgccgactccccgcatttaattgagcgattcaccgcgctgtttaatagtcatgaaatgaatattgcggagctggtctcccgcacgcagccggctgaaggtgataaagctgcgcaattatttattcaaatcaccgcacatagcccggcgtcgcaaaattccgcaaatattgagcaagcctttaaagcactatgtacagaactcaatgcgcaaggcagtataaacgtcgtcaattactcacaacatgatgaacaggatggagttaagtaatgaatccactgaaagccggtgatatcgcaccgaaatttagcttgccggatcaagacggggaacaagtaaatttgaccgacttccagggacagcgcgttctggtttatttctacccaaaagccatgacacccggctgtaccgtgcaggcctgcggcttacgcgataacatggacgagctcaaaaaagcaggcgtggacgtgctgggcatcagcaccgataaacctgaaaaactctcccgtttcgctgaaaaagagctgctgaactttacccttttgtccgatgaaaaccatcaggtgtgtgaacagttcggcgtctggggcgaaaagtcgtttatgggcaaaacgtatgacggcattcaccgcatcagctttttgattgacgctgatggtaagattgaacacgtctttaatgattttaaaaccagcaatcaccatgatgtggtgctgaactggctgaaagaaaacgcgtaaaagcctcaggccgcgctgatgtgcggcctggaaagggaatgcgccgtcaggcttgccgcgccagacgcccttctccggtcatcaccagatcggcatctttaaccgcctgctcaagctgtagcgtttccacgacaatctctacgccggcgcgtaattcagcattgagcaaccctaaaagcgcggcgcccattccgcctgccgcgccgggagcgttaatcacctcacgtcccgtagcctgataaatatgccggccgcagttttccagcgcctcgtccagggtgttcaccatttccgctgtcgcccctttttgtgggccaaaaatggccgatgcgccctgaggaccacacagcggattgttgacatcgcacgcctttaagctgattggcggtagcggaatcaatttctacaatacagttttccttcagcagcgagaattttgtaggttccgacaataaaaatgccgcaacacggtgcggcattaaaaaaaagagcggctttctaagcgcttgtccctcatcaggcgtgcgcaaaatggcggcagggcactatgatgtcgttcacgctttacaacttttgtactgaccgctcaggatgaggcatccgtcacctgaccatccggccaggcatggacaacggctttaatcagcgtcgccaatggaatggcgaaaaacaccccccagaaaccccacagaccgccgaaaatcaccactgacagaataatcaccagcggatgcaaattcaccgcttcggagaaaagtaccggtaccagcaaattgccatccagcgcctgaataatgagataaacggcaaaacagctccagaattccgtccccagaccaaactgaaacagcgcgacgcccaccaccggaattgtcaccacaaaggcgccgatataggggatcagaaccgaaaagcccaccagtaccgccagcagtagcgaatagttgaggccaaacagcaaaaaacccagccaggtcgctacgcccaccaccaccatctccagcacttttccgcggatatagttggtgatctgctgattcatctcattccacacctgccccgccagcccgcgattacgcggcagcacgcggcgcacggcattcagcatctgctctttatcttttaccaggaaaaagaccatcagcggcaccagcaccagatataccgccagcgtcagtagcccgactaacgaagccagcgaatacttcaccaccgaatcgcccatgttaagcatccgggtacgcatgttttccgccatcgcatcaataatgcccgcatccatcagcgccggatagcgtcgcggcaaggtcgcggcgaaatcggacagtttattcagcataccgggcatatcacgaatcaggtaaataccctgctgccaggcaatcggcatcaccacaaacgccattaataacagaatgccgacaaaaaggataaggacaatggaggctgcccagcgccgggaacagccaatcgcctgcaggcgcgccgtcggccactccagcaggtaggccagtacgatagcgaccagcagcggcgctaacaggccgctaaagaaaaagaggatgctaaaaccagccaccagaatgaccagcaaggcaatcgcctccgggtcgctgaagcgacggcgataccattgcattaacatttcgagcataaaacccttcccagaactcaactgcgggattgtgatgccgaattgtatcgaaatgtcacaaaaaagacttcgctttttatcgttgattcaggaaactaaaatagtgagtctgtgctcatcacagttacacttatgaagtgtcggagcgtggaacgatatttcacgacgttggtcaaagggctatctcaaaacaacaggatagaggttatgttcaggcagttgaaaaaaaacctggtggcaaccctcattgcagcattggctctcggtcaggtcgcgcccgcatttgccgaccctgccgacacgctgcccgatatgggaacctcggcaggaagcacgctttctatcggacaagagatgcaaatgggcgacttttatgtgcgccagctacgcggcagcgcgccgttaatcaacgatccgctgctggtgcaatacattaacgcgctgggtatgcgtctggtctcgcacgccgactccgtcaaaacgcccttccattttttcttgatcaataatgacgaaatcaacgccttcgcgttctttggcggcaatgtggtgctgcactcggcgctttttcgctacgcggataacgaaagccagctagcttcagtcatggcgcatgaaatctcccacgtgacgcagcgccacctggcgcgcgcgatggaagatcaaaagcgcagcgcgccgcttacctgggtgggcgcgctgggttccattttgctggccatggccagcccacaggccggtatggcggcgctaaccggtactctggcgggaacgcgccagggaatgataagtttcacccagcaaaatgagcaagaagccgaccgtattggtattcaggtactgcaacgcgccggatttgacccacaggcgatgccctctttcctcgaaaaactgctcgaccaggcgcgttactccacgcgcccgcctgaaattttgctcactcaccccttaccggaaagccgccttgcggatgcccgcaaccgtgccaaccagatgcgcccggtcgtggtgcaatcttccgccgacttttatttcgccaaagcgcgcgccctgggaatgtacaattccggacgtaaccagcttaccagcgacctgctggatcagtggtctaaaggcaacgtgcgtcagcaacatgcggcgcaatatggccgggcgttgcaggcgatggaagcgagcaagtacgatgaagcgcgcaaaacgttgcagccgctgttaagcgcggaaccgaacaatgcctggtatcttgacctcgccaccgatattgacctggggcagaaaagagccaacgacgcgattaatcgcctgaaaaatgcccgcgatctgcgcgttaatcctgtgctgcagttaaacctcgccaatgcgtacctccagggaggccagccgaaagcggcggaaaccattctgaatcgctacacctttagccataaagatgacggtaacggctgggatctgcttgctcaggccgaagccgcgctgaacaaccgcgatcaggagctggcggcgcgcgctgaaagttatgcgctggcgggacgactggatcaggcaatttcactgctcagtagcgccagcgcccaggcaaaactgggtagtcagcaacaggcgcgttacgatgcgcgtatcgaccagttgcgccagttacaggaacgcttcaagccatacacgaaaatgtaatcgccgtttattagccggatggcgtcacaaggagaactcatgaccgacacgattaaaatctaccataacccgcgctgctcgaagagccgcgacacgctgaacctgctgaaatctaacggcgtggaaccggaagtggtgctttatctggatacgcccgccgatgccgccaccgtgcgggaactgctgcgtatgttgggcatgtccagcgcgcgcgaactgatgcgccagaaagaagatctctataaaacgcttcacctggcggatagtgagctgagtgaagaggcgttaatccaggcgctggttgaacaccctaaactgatggagcgccccattgtggtggcaaatggtcaggcgcgcattggccgaccgcctgagcaggtgctggacatcctcggttaaccgttgaacgccgccgtcgcggcgtattacagtttcaggatctctttgacaaacgggatcgtcagttttcgctgggcagtgatcgacgcatgatcgagctgatccagcgtcataaacagcgtgcgcatttcgcgatcaagacgtttgagtaaaaaccgcccgacatcttccggcagttcaaacccccgtaaccgggcgcgcaactgtagcgcctgaagtttgtcttcatcggaaagaggctggagtttatagatttgcccccagtccagacgggaagcgagatcgggcaagcccagatttaactgtcttggcggacgatcgccggtgatcaataaccgcgtcttaccggactccagaatgcggttatagagatcaaagatcgccatctcccacagttcatcgccagcgacacactcaatgttatcaatacacaccagcgagaggtgttccataccgtcgagcacttccggcacgaaccaggtacgtttatcgagcgggacgtagcctaccgcatctccacgctgcgacagttcagcacaggcggcgtgcagtaaatggctgcggcccgcgccttcacgcgcccaaaggtagatatatccactatgttcctggcgcaacacgttttgtaacgcggccagtagagaggcgttatcccccggccagaaacttgcgaaagtttcgtcgtcaggaagataaagtggcaaagagagctgtgccggtgtgttcagagatacctcaacccaggatgacataaaatcgcgctgagtttaccacataattcccgtgagatagaaccgggcagcatcgctgcccggcaacccgttactgatgcgggggctccgcatcatttgcctccagtaccacttcttccggacgcaacaggctaatcagtttaaaaatcaggctcaggcaaatcccgacgatggtcgccagcgccatccctttcaattctgccgcgccgatatgcactttcgcgccgctcacgccgatgatcaaaatcaccgaggtgaggatcaggttttgcgctttgttgtagtcgactttcgattcgatcaagacgcgaatccccgacgcgccgataacgccgtacaacagcagcgagacgccgcccatcacgggtaacgggataatctgaatcgccgccgccagtttgccaacgcaggaaagcagaatggcgaaaatcgccgcgccgccgataacccaggtactgtaaacgcgggtgatcgccatgacgccaatattttccccataggtggtattcggcgtggagccgaagaaaccggaaatgatcgtcgacagtccgttagcgaacatcgagcggtgcaaaccgggatcgcgcactaaatcttttttgacgatattcgccgtcaccaccagatgaccgacatgctcggcgatcacgaccaacgccgcgggcagaatcgtcaggatcgcgaaccattcaaaacgcggcgtatagaaggtcggcagcgcaaaccagtgcgcctgggcaatcggcgtggtatcgaccacccccagcgcgaatgacagcgcatagcccgccagcacgccgatcaaaatcggaatgatcgccaggaaaccgcgaaacagtacggagccgaacaccgtcaccgccagcgtgaccatggagatgataattgttttcgtgtccggcgactgcccttgcgcaggcagtaatccggccatccccgccgcgacgccagccagctccagaccgatgacggcaacgattgcgcccattgccgcaggcgggaacatcacatccagccagccggtgcccgcttttttaacgatgaaagagaccagacagaacaacacgccgcacataataaaaccgcccagcgccacttcataacccagcggcaacaacagtaataccggggaaataaaggcaaagctcgatccgaggtaggcaggaattttacctttgcagataaagagatacagcaacgttccgataccgttaaacagcagcaccgtcgcgggattgatatgaaacagaactggcaccagcacggtcgcgccaaacatggcgaaaaggtgctgtaaactaagcgggattgtctgtaaaagcggcggtctttcactcaccccgatagcacggcgcgtcatagtgttttcctctaagtgtgtttgttatgagtggttttattcaaaaaaaagccgactcttaaagtcggcttttaattatttattcacttatttggtaccaaaaatcttatcgccggcatcgccaagccccggaataatgtatccgtgctcgttaagcccctgatcgatagaggcggtgtacagttcaacgtccgggtgcgctttttccagcgccgcaatgccttccggcgcggcgaccagcaccagcaccttaatgctgctacagcctgcttttttcagcaggtcgatggtcgcgatgacagaaccgccagtcgccagcatcgggtcgacgatcagcgccatgcgctcatcaatgttcgataccagtttctggaaataaggtactggctcaagcgtctcttcgttacggtacatcccgactacgctgatacgcgcgctcggtacattttccagaacgccttccatcatacccagacccgcgcgcagaatcggcacaacggtaatttttttacctttgatctggtcgatttccaccgggccattccagccttcgatggtgactttttccgtttccaggtcggctgtcgcttcatacgtcagcaggctgcctacttctgaggcgagttcacgaaagcgtttagtgctaatgtcgttttcacgcatcagacccagcttgtgtttgacgagtgggtgtttgacttccacgatcttcatactcttctcctatcctcagatgactggcaaccacaaaaaaaatcgccggattataccgcttttcctctctgacgcaacacaatgtatgcttgacctggatcaaccaaaagcgctgatagcggaaaagtgagtataaatcactcacgttgaaacaggcgataaaggctaacaaccgtttgaatattagcaattttaagggtgaatgacctgtcccgaccgcctgtcgtaaaccaagtgctggatatccttttcttttttaccaacagggaaattttcaagcagcgaccgaaaccatgcaaaaaaaatcgcccggataaccagggcgcagaccacgctcgcaaacgtttgctttccctgttagaattgcgccgaatttaacttttaccgcaagaaaaaacgtggggaaccaggcagtgaccgataagacctctcttagctataaagatgccggcgtcgatattgatgcgggtaacgctctggttgatcgaatcaaaggcgtagtgaagaaaactcgccgcccggaggttatgggcggtctgggcggtttcggtgcgctgtgcgcgttgccgcaaaaatatcgtgaaccggtactggtttccggcactgacggcgtaggtaccaaacttcgcctggcgatggacttaaagcgtcacgacgctatcggtattgatctggtggcaatgtgcgtaaacgatctggtcgttcagggcgcggaaccgctgtttttcctcgattactatgccacgggtaaactggatgtcgataccgccgccagcgtgatcaacggtattgccgaaggctgcctgcaatccggctgcgcgctggtcggcggcgagacggcggaaatgccgggcatgtatcacggcgaagattacgatgtggcgggtttctgcgtcggcgtagtcgaaaaatcagaaatcatcgacggctcccgggttgccgaaggcgacgtgctgattgcactcggctccagcggcccgcactcgaatggatattcgctggtgcggaaaattattgacgttagcggctgcgacccacaaaccactctgctggaagggaagccgctggccgatcatctgcttgaaccgacccgtatctacgtaaaatcggttctggaactgattgaaaacgtcgatgtacacgctatcgcccacctcaccggcgggggcttttgggaaaatattccgcgcgttctgccggagaatacccaggcggtaattaatgagtcgtcctggcagtggcccgccatctttacctggctgcaaaccgccggtaatgtcagccgacatgaaatgtaccgtacctttaactgcggcgtcggcatggtgattgcgctctccgctccggaagcggacaaagcgcttgctctgctaaacgagaaaggtgaaaacgcatggaaaatcggtatcatcaaagcctctgattccgaacagcgtgtggttattgaataatgaatattgtggtgctgatttccggcaatggaagcaatttacaggcgattatcgatgcctgcgaagcgaagaaaattaaaggcaccctcagggcagtattcagcaataaggccgacgcgttcggccttgaacgcgccagagaagccggtattccggcgcaagcgctgactgccgatcggtttgacagccgcgacgccttcgatcgcgagctgattcgcaagatagacgcgtatgcgcccgatgtggtcgtgctggccggttttatgcgtattctgagtccgatgtttgtcgcgcattactacgggcgtctgctgaacattcacccttccctgctaccaaaatatccggggttgcatacccatcgccaggcgctggaaaacggcgatgaggagcacggtacctcggtacatttcgtgacagacgaactcgacggcggcccggtcattctccaggcgaaggtgccggtttttgccaacgacagcgaagatgatatcaccgcacgcgtacagactcaggaacatgcgatttatccgctggtgattagctggtttgcgcaggggcgtctaaagatgcgcgataacgccgcctggctggacgggcgtcgtctgccgccgcaaggttatgcgtctgacgaataatatgtcatcggacaggactgcgtctgcttgccggatggcggcataaatgcctatccggcctactcttttcccttcctttatgctatcagtttattgtcatatttttctgacgctgttggacattaacgcgtaatgctcgccataattatcaggcagtgtcccgtgaataaaacggagtataggtagtaatgggtcaggaaaagctatatatcgagaaagaactgagctggttagcatttaacgaacgcgtgttacaggaagcagcggataaatccaacccgttgattgagcggatgcggttcctgggaatctattctaataacctcgacgagttctacaaagtgcgtttcgctgaactgaaacgacgtattattatcagcgaagaacagggttcaaattctcattcacgccatttgttaggcaaaattcagtcccgcgtgttgaaagcagaccaggagttcgacggcctgtacaacgaattactgctggaaatggcgcgtaatcaaatctttctgatcaacgagcgtcagctctcggtgaaccaacaaagctggttgcgccactattttaagcactatttgcgccagcatattaccccgattctcattaaccgggagacggatcttgttcagtttttaaaagatgattacacctatctggcggtggagattatccgtggcgacaccatcaactatgcgctgctggagataccgtccgacaaagtcccacgcttcgttaatctgccgccggagacaccgcgcagacgcaagccgatgatcctgctggataatattctgcgctactgcctggatgacatttttaaagggttcttcgactatgacgcgcttaatgcctattcgatgaaaatgacccgcgatgccgaatatgacctggtgcatgagatggaatccagtctgatggagctgatgtcttccagcctgaagcagcgcctgaccgctgagcctgtgcgctttgtctatcaacgcgatatgcccgccgcgctggtcgacgtactgcgggaaaaactgacgatctcccggtatgactcaatcgtacccggcgggcgctaccacaattttaaagactttattaattttccgaatgtcggtaaagccaacctggtcaataaaccgttaccgcggttacgccatctttggtttgataaagagaagtttcgtaacggtttcgacgcgattcgtgaacgtgatgtgctgctctattatccttatcacacctttgaacatgtgctggaactgctgcgtcaggcgtcgtttgacccaagcgtgctggcgatcaaaatcaatatttatcgcgtagcgaaagactcgcgcattattgactcgatgatccatgccgcccataacggcaaaaaagtcaccgtggtggtggagttgcaggcgcgcttcgatgaagaggcaaatattcactgggccaagcggttaaccgaagcgggcgtccatgttattttctctgcgcccgggctgaaaattcacgccaaactctttctcatctcacgaaaagagggtgatgacgtggtgcgttatgcgcatatcggcaccggtaacttcaacgaaaaaacagcgcggctgtataccgattattcgctgctgaccgccgatgcgcgcattaccaatgaagtgcgtcgggtctttaattttattgaaaacccctatcgcccggtcactttcgattatttgatggtttctccacaaaactcacggcgtctgctgtatgagatgatcgatcgtgaaatcgccaatgcccagcaaggcttaccgtcagggattaccttaaagcttaacaacctggttgataaagggttggtcgacaggctatacgccgcgtcgggttcgggcgtccaggtcaatctgctggtacgcggtatgtgttctcttattccgcaactggaaggcattagcgataatattcgtgcgattagcattgtggatcgctatctggaacacgatcgggtttatattttcgaaaacggcggtgataagcaagtttggctctcttcagctgactggatgacgcgtaatattgactaccgtatcgaagtcgctacgcctatcctcgacccgcggcttaaacaacgcgtcctggatatcattgacattctgtttagcgacacggtaaaagcgcgttttatcgataaagaactcagcaaccgctacgtaccgcgcggcaatcgccgtaaagtccaggcgcagctggcaatttatgactacatcaaatcactcgagcaaccagactaacgctatgccaatttacgataaatcccctcgtccgcaggagttcgctgcggtcgatctcggctcaaacagctttcatatggtcattgcccgcgtggttgacggcgcaatgcagattatcgggcgcttaaaacagcgcgtccatctggcggacgggctgggcgcagataacaaactcagcgaagaagccatggaacgggggcttagctgtctgtcgctgtttgctgaacgcttacaaggtttctccccttccagcgtctgtatcgtaggcacccatacgttacgtcaggcgcaaaatgccgctgattttctcaaacgcgcggaaaaggttattccctacccgatagagattatttccggtaacgaagaagcgcgcctgatttttatgggcgtagaacatacgcagccggaaaaaggccgcaagctggtgatcgatatcggcggcgggtcaacagagctggtcattggcgaaaacttcgaacccaggctggttgaaagccgtcgtatgggctgcgtgagcttcgcgcagctctactttcccggcggcgttatcaataaagaaaacttccagcgcgcccgaatggcggcggcgcaaaaactggaaaccttaacctggcagtatcgtattcagggttggaacgtagcgatgggcgcttccggtacgattaaggccgctcatgaagttctcctggcgctgggtgagaaagatggcttcattacgccggagcgcctcgataaactgaagtcagaagtgttgaagcaccgctcctttaatgcgctcagcctgccgggtctgtctgaagaacgaaaagcggtctttgtgccgggcctggcgattctgtgcggcgtttttgatgctctggctatccgcgagcttcgcctttccgacggcgcattgcgcgaaggcgtactgtatgaaatggaaggccgcttccgccatcaggatgttcgcagccgtaccgcaaaaagtctggccaatcaatacaacattgacagagaacaggccagacgcgtgctggaaaccaccatgcagatgtacgagcagtggcaggcccagcagccaaaactggcgcatccgcagcttgaagcgttgcttcgctgggcggcaatgctgcatgaggttggactgaatattaatcacagcggtttacatcgccattcggcttatattctgcaacacagcgatttgcccggctttaatcaggagcagcaaatgatgatggcgacgctggtgcgttaccatcgtaaagccataaaactggatgatatgccccgctttacgctgtttaagaaaaaacagtatctgccgttaattcagctacttcggctgggcgtattactgaacaaccagcggcaggcgaccaccacgccgccgacgctgcggctaacgaccgatgacagccactggacgttatgttttccgcatgactggttcagccagaatgcgctggtactgcttgatctggaaaaagaacagcagtactgggaagcggtaactggctggcgtctcaatattgaggaagaaagctcgccggagatcgccgcgtaaattgtgagccagacgccgcgccgcggcgtctgtctttactgaatctcagataatagctgcggctcgccaattaaatatccctgaagatagtcgatccccaacgagagcactacgcttcgtatttcttcgctctcgacatactccgcgacgacctgcatatttttcattcgcgctaaatgacaaatagaagccacaatctgataatcgagactgtttgacactatattgcgaataaaactgccatcaattttaagaatatcggcgtcgacgtttttcagccgcgcatagctggcgtagccagtaccgaaatcatcaatcgctatctgacagccaaactgctgtagctgtcccagcgtcaactgcgcctgctcagcattggtgagagagttgctttccgttacctcaaaaaccagttgccagggttcaacctgatattgcgtaagcagctgcttaacttctgcagggaaacgagcgcggcataccgatgttggcgacagattaatggcaaaacgatgcgcgggcatatattcccggctggccgccataaaccgcagcgtgttttcaatcacccaaagatcgatagcggaagacaatccaaactcatgcgccacgggtaaaaaattgtccgggttgataacgtcgccgttgtcatccctgagtcgcagtaagatttcatggtaaacgtccccacgaacaccgaaaataggctgcgccatcaggaaaaaatgatcgtgctccaacgcctgttgcaggcgattcatcatcgcaattctgcccttcaaatcgcgctgcaggtgcattgcgccgcgccgctgtaaatcctccggcgcgttagtcgtcaacgaaagatcggaactggtgcttaattcgcccaacagcagataaaggtggctaaccggagaacgcacgcagcaatagctcacgccgacaggcggctgtagcggcagtccatcccagataaaccgaaactgcttaatatgtttatccagcgcttcaatacgctgctgatgcgcctctgtattaagacgcagcaccaggtcgtgccctgacatctggtagacgcactcatttgaggccagcatcggcgtaatccagtgagagagcttttgcttatactggatgcgtagcatgacgccataatttttacccaatagctccaggcccggcacgtgtaaaaaacagatcgtagaccagggcgcattttggagcgcgcggtttaacgcacgtaaattgggaagatgtacaaccgggtcaagataggccagccgccgtgcgcgaccactcactacgcgctgacgcgtggccagtacagacatataattaacaataaaagaaaaaaccagatagctcgaagaggtaatcgctaattgcgtatcataacctgaataccagggcatataacgctgataataatgaatcgacgtaattagcacgacggcccagataattgaaataaacttatagccatagcgcatcgcgccccacagcatgaccggcaataataacgaaagcgtatagttggtactaaatattgaactattatcagtcaatggcatacacagtataaacattagtgtagtcaatacggccagccaaataacgatctcttttttagtggccttgctatcaatctgtagctttaattgctgataatacccccgtaggtgcagcggattgcgaagagtacgaataataaaatagcacaatggcacgccgacaaggttaccgaccagtaacgcctggtaattaatcagcgtgttgatattaaagggcattacccccatcaggctggctttgctttcgtacatgccaacaaaagcggcaaactggtagatgaccagaaataatgttgctgaacaaaatacctgccagaatattcgttgaaacagcaggtgggcgtcgccgtgggaaacattgtttcgccggggggaaaagacacgatagccgccccagcttagcacgatagtaatgataaagtgcatcgtcacggaaagggtttcatacagccctgtctgcgggtatctgcgccagaagatagcaagcacaatgcccggcagtgctgcccagccgaaaaagagcatcaggctaagcataaaagctaacggcaggtaaaaaagaaccacatttccagtgctggtaagcgcataagtatttgcgctacttaaaacaggcagtaaaatcgaagggagaatgagcggtagtccccaccatttatctctgatatttatataagttttatttagtttcatagatgctcagcagaaccccccaatcccaaaggggcgttaacagacaggcatcccacctgactttaaattgatgatgagatatacatcacacgatagtcatcgattgtaattattaaacaaaagtaacatttgatttaagtcaattattacctttctcctgcagcctttattcgcctttttattctttgttatcattaatttattattaatgtaaatactaaaattatcttccataacaatataagataaatcaactgacgcaattttacattaagaggaattgaccatcggttcgcagtatgccttaatgtagagtgaacgcaggcttgttacgttcttcgccttgataatacccttgaagaacccagcctgatcccgcccatatcgctgggccaacgttaaggaaccctttgtgagtcaggccaacagtatgcgaaaacgacatcgatttaacactcgcatgacccgtatcgtactgcttatcagttttctcttcttctttggacgtttcgtctactcttctatcggcgcctggcagcaccatcaggataaaaaagaagcgcaacagtcatcgctttctgtcaccacgccgggacaacgttaagctgttatccgttaaaaagcccgcgcaagaaaaagaagctttagcgttaacgcaaaaagacaatcccactcaatgggttcaggccatgatcagacgcttaaagagcaaccgcgggatatcctgcctgggtgataagatcacatgcgcggttactaagattccctcgaccgaatacaaaacccgatagccttcagcgtggttaaactcccggtagctggcacagccaattttcagcagttcagggcaaccagttctacctacgaggggtaaacctcgtgggacaactccagtaacattaattgcttctaagtacatcagtaattggttgaactataaactgccacctgggatcagattaccaacgttgacaggcaaaactatcaactcattacagctaagctcaacgaataatttaggtcgtttcgttggtcgtaatgtaccctggctcggttgggttatgacattcactacgatttatgatatccagcgtaatattaaagatacatttaatcgtgtggcggttcctaaagatcgcattaagtggacgtacttctaatgagagatattgagaaagaaattatcgattttatcgatcaggaatataacactaaaaagtactttctctgtgggccaaagcgaatcatcacgcttgataccagtattagggatgatcttaaactcgtttttgaagatagtgaagaacttctacaaaagtacttcaagcgttggaatgtagattcagaaggatttgacatactcaactatctgaatccagagtactttggaagtaaagagcctgatccgcgtaagccactaacggttggtatgctcgttgaaagtgctaaagctgggcgttggttatatagttgaagaataaagttactatattttaaataccccttatttgggctgaatcgccacggataacctggacacttctgagtcgttggtagatctttttctttatccgttcacgcttcagtagctggaaaaagctttctgcaaccgcattgtcatgacagttgccacaacggctcatactgccctccagtccgtgcaatttcagccattcatagcgggtgtactgactaccctgatcagactgaaccagcacctgtttttggggatgacgtcgccacacggccatcagaagcgcattcagaacaatatcttttgtcattcgtggttgcattgaccaaccgataactttgcacgagaacaaatcaacgaccacggcaagatacaaccaaccttcgtgggttcgtaattacgtcaaatttgccgtcaggaactgtgcgccacatagaaaattcatgaatgcacataaataaaaaccctctgtaaaaacagagggttaaattcacctttacctgttcatgaaaacacaggaaggattatcggcttattcccactcaatggtagccggcggtttaccgctgatgtcatacaccacacgggaaatcccgttgacttcattgatgatgcggttggaaacgcgaccgaggaagtcatacggcaggtgcgcccagtgtgcggtcataaagtcgatggtttcgacggcacgcagagagacaacccagtcatacttacgaccatcgcccataacgccaacggaacgaaccggcaggaagacggtaaacgcctgactgactttgtcgtacagatccgctttgcgcagctcttcaatgaagatagcgtcagcacggcgcagcaggtcgcagtactctttcttcacttcacccagaacacgaacgccgaggcccggccccgggaacggatggcgatacagcatgtcatacggcaggcccagctccagaccaatcttacgcacttcgtctttgaacagctctttcagcggttcaaccagccccatcttcatctctttcggcaagccgccgacattgtggtgagatttgatgacgtgcgctttaccggttgcagacgccgcagattcgataacgtcagggtaaatggtgccttgcgccagccacttcacgtcttccagtttgagcgcttcttcgtcgaacacttctacaaaaacacgaccgatgatcttacgcttggcttccggatcgttctcgccagccagcgcggacaggaagcgctcttctgccggtacgtgaacgatattcaggccaaaatggtcgccaaacatgtccatcacctgctcggcttcgttgagacgcagcaggccgttgtcgacgaatacacaggtcagatttttaccgatcgcgcggtgcagcagcattgcggtgacggaagaatccacgccaccagagaggccgaggatcactttgtcgtcgcccacctgctcgcgaatgcgcgccacggcgtcgtcgatgatcttcgccggcgtccacaacgcttcacactggcagatatcgcgtacaaaacgctccagcatgcgcataccctggcgggtgtgagtcacttccgggtggaactgtacaccgtagaagcgtttttcttcgttggccataatggcgaacgggcagctctcggtgctggcgacggtcacgaagtcggacggaatcgccgtcactttatcgccgtggctcatccacacgtccagcagcggtttgccgtctgcggtcagggaatcttcaataccgcgaaccagcgcgctgtcggtcaacacttcgacctgcgcataaccaaattcacgctcattagaaccttctacatgaccgccaagctgcatcgccatggtctgcataccatagcaaacgccaaataccggcacgcctgcttcaaagacatactgcagcgcgcgcgggctgttttcttcggtggtgctttccgggccgccggaaagaataatgccgcttgggttgaagtcacgaatttgtgcttctgtcacatcccacgcccacagttcacagtaaacacccagctcacgcacgcggcgcgcaaccagttgagtgtactgagaaccgaagtccagaatgaggatgcgatgcttatgaatgttttccgtcattgacgcttattccgaggcaagtgaaacagattaaataaatcgcccgacacgaaggtcgggcgaagaaaatcaggagcccagacggtagttcggggactctttggtgatggtcacgtcgtgaacgtggctttcctgaatgcccgcaccgctgatacgcacaaactccgctttagtacgcagttcgtcgatggtagcacaaccggtcagccccatacaggagcgcaggccgcccatctgctggtgaatgatctctttcaggcgacctttataggctacgcgaccttcgataccttccggcaccagtttgtcagcggcgttgtcgctctggaagtaacggtcggaggaacctttggacatcgcacccagcgagcccatgccgcggtaagatttgtaagaacggccctggtagagttcgatttcgcccggggattcttccgtacccgccagcatggaacccaccattaccgcgcttgcacctgcggcaatcgctttggctatgtcgccggagaaacggataccgccgtcagcgataaccggaataccggtaccttccagcgcttcaactgcgtcagaaacagcggtgatctgcggaacgcccacgccagtcacgatacgagtggtacagatggaacccgggccaataccgactttcaccgcgctgcaaccggcttccgccagtgcgcgagcgcctgcgcctgtcgcgacgttgccgccgatgatttgcaggtcaggatatttagcacgggtttcacggatacgttgcaacacgccttctgaatgaccgtgagaggagtcgatcagcagtacgtcaacgcctgccgccaccagcgcgtcaacgcgctcttcgttgcccgcgcctgcgccgaccgccgcgccgacacgtaaacggccctgctcatctttgcaggagtttggtttacgttccgctttctggaaatcttttacggtaatcatgccaagcagatggaagttatcatcaacgaccagcgctttttctacgcgtttttcgtgcatttttgccagcacgacttcacgggcttcgccttcacgaacggtcaccagacgctctttcggcgtcatgtaaacgctaaccggctggttcaggtcagtcacaaaacgcacgtcacgaccggtgatgatacccaccagctcgttatcttcagtcaccaccggatagcccgcaaaaccgttacgctcggtcagggctttcacttcatgcaacgtggtggttggcaggacggtctgcgggtcggtcactacgccggactcgtgtttcttcacgcggcgaacttcttccgcctggcgctcaatggacatgtttttgtggataaaaccaatgccgccttcctgggccagggcaattgccaggcgcgcttccgtcacggtgtccatcgccgcagaaagcataggaatattcagacgaatagttttcgtcaactgcgtgctgagatcggcagtattcggcaaaacggtggagtgagcgggaacaaggaggacgtcgtcaaacgtcagggcttctttagcgatacgtagcatgggcaatatctcacctgggaggttaataaatattgccgcggcattatacagaacgtaatcggttgcatctacatttttttgcaaatagtgcttgcgatcccccgtgagcaggttactatcgattgaataacctgctgatttagaatttgatcccgctcacatgttatcctctcaaacttcctcaatttttaccgtaagccgccttaaccagacggttcgtctgctgttagaacaggagatgggacaggtatggatcagcggcgagatttctaatttcacgcagcctgcgtcgggccactggtactttacgctcaaagacgataccgctcaggtgcgctgtgcgatgttccgtaacagcaatcgccgggtgacgttccgcccgcagcacgggcagcaggtgctggtacgcgccaacattacgctgtacgagccgcgcggcgattatcaaatcatcgccgaaagtatgcagcccgcgggcgaaggcttgttgcagcagaaatatgagcagctaaaagccaaactgcaggccgaaggcttgttcgatcagcagcataaacagccgttgccctccccggcccactgcgttggggtgatcacttcgaaaaccggcgcggcgctgcacgatattctccacgtgctaaagcgtcgtgacccatccctgcccgttattatctatccaaccgcagtccagggcgacgacgcgccggggcagatcgttcgtgctatcgaactggcgaacgcgcgcggcgaatgtgatgtactgatcgtcgggcgcggcggcggttcgctggaagatttgtggagttttaacgacgaacgcgtggcgcgggcgatttttgccagccgcattccggtggtcagcgccgtcggtcacgaaacggacgtcacgatagctgattttgtcgccgacctgcgcgcgcctacgccatcagcagcggcagaaattgtcagccgtaaccagcaggagttgttgcgtcagatccagtccgcccagcagcgtctgggcatggcgatggactactacctcgccaatcgcagccgccgtttcacgcagatttttcaccgtctgcaacagcaacatccgcaactgcgtctggcccgtcagcaaaccgcgctggaacgtctacgccaacggatgggatttgcgcttgaggccaggattaagcaggccaatcaacgccaacagtgcgtaagtcaacgcctgagccagcaaaatccgcagccgcgcattcaccgcgcgcagtcgcgcatccaacagcttgaatatcgtctgacggagaatatccgctcacggttaagcgaacagcgcgagcgttttggcaacgcggtcacgcatctggaagcggtcagcccgttagccacgctggcgcgcggctatacggtttcgacgacaacggacggcaaggtgctgaaaaagatcaaacaggtcaaagcaggcgatatcatgaccacgagactggaggacggctggcttgaaagtgaagtcaaatccgtcacgccgggcacgtaatccaacactcccccaccctttgcagcgcgatgttgggtttcgacttcgcctcagccaacctacgcgccacgtcggataaggtgtagccataatctgacgatcaaccggtttgtcattcgcctcaaaaccgggcagggaacacccgcccggttttgtctaacttaccagttatagcgcagattgaggctaccgttcagatcgccaaagtcattgctgccagtctgcccggcaacctgagcgcgaacgctccactgcttatcgatatctgcctgcagacccactttcagctccgcacggttagccggaagatcctgtttcaccgtagcatcatcaaacgataccgacacatcatcgctggtgtgcagccagttagcttcagcaaacggctggataaccgtacggctgcctttgtacagcttgccgtcaacacgcagacccagacgcgttgtccaactgtcgccatcctgaccatcaatccgggtgccgtagttatccttcacgctatccgctgagtaattctgccagacaacctgcgcctgcggcgtcagactgacagtattaccgttgctaagcgcaatatcgtagcgataaccagtttccagcgagacggcgttagcggttgaatcataagattcagatcccgcatcaccgctctctacgctgttgttgtagaaaccatattggtaccagctgtcgacatacgcgccgctatgcgtttgggcatcggcaaaccaggtggcatagacgccaaggttgtagccgtctacgttgccgctactggtgaactggctaccgtctgcgccacggttaccggtgctgtcggtatcggcgttgatgtagctcgccatgacgccaacggtaacgctctgctggccgttaccccaggccagaatgtcgccgcctaactggaactgggagtagttgctgtccatatcgatattgccgctgacagcctcggattccgctttacccgctttgaagcgcgcccatacgctgccatcggcattacgatactggctgccctcgcggtcatagagggtctgcatttgcaggttgcgcgccatccactggttgcccatgtacgcgccgatatccgcacggtactgcggtgcgacatcgccgccgtggtccggaggcgtgacatcgccgccgtcgccgccgtcgtccggaggcgtgacattaccgccatcgccgccgtcgtccggaggcgtgacattaccgccatcgtcaccgccatccgaaggcgtgtcatcaccgccgctgtcgtcatcatcagactgtgcttttgacgccagataccagtcgttgtcactttcattccagtacagacggtaggtatacagaccggcgttaacctcattttttagctcaaacgcatcgctggtcgatacgccgccaacatccaccacttcgataccgttagtggtctgtgctccatcgccgatgccgttgatgtacagatcggtggtgccggaagcatcgccggtaatgaccaacttatcggttgccgaatcatcgtcgcccaggacggtattcaggtaaagcgagccgccgttgccggtgtaattgccatcgacataaagcgtattgccaggcgtgctggagctgctaccactggtcattgtccccatgttgatcagatcgccattgagggtgaagatagcgcctgtttcctcgctgttgccgaagaccagcgtcccttcgttggtcaccttaccgttaacggtcgtaccattgctgccgccgaaggtcgccccggaggcgacgttcaccgcctgctggctgcccatctcgccaatcgagccgtctccggacagccatagcgtgccttcctgtacgttggtatcgccgctataggtgttcgcgccgctcagcgtcagtttacccgcgcccagtttggtcagcgatttaccgtcccagtcgccgttgccggttttatcgcccagtacgctggtgacttcaaaactgtcgcctgcgcccagggtaaacgtgccgtgtgctggcgtcgctgacgtggcggtcgcattccagctcagcccttcggtaagcagatattctgacgcatcttcaggattgattgtcccggttacggtcagatagtccggcttgtcagtgaggttcatcgtcaggctggtaaagtcgccgctgatatcgctggtcatatccatcagtttaaaggactggaactccgcgtcggaggcgcgcgcttgcaggctggcgtcgctgacgaccaaatcgccgccaagcgtggcgctgctgccggtaatcagcggttgcactgagtcactattcagctcaacgttcagcgtactgccatcttgctgaattaacgcgctgtcgccgagatccaacgaggtgccgagcgccagttgggtcgtcgcgccgctatgagtggtgatgccgcccaccgcgctgacttcaccgtctgcgtccagcaccagcgtggcattattgtctaccagaccggtgcccagcgccgtcgtactggcggcgaccagcgtaccttcattgatggtggtgccgccgctgtagtcgttgtcgccagagaggatcagcgtgcctgcgccttctttggtcagcgatttaccgtcccatctgctacccggatccagcgtatcgtcaacgtctgtcagtgtagccgcaacgttaaagctgccgtcagggtcgctcagggtaaaggtgccgtgggcgtcggtagtggcgttgtctctgtccgcataccaggagagggaggccgtcagatcatagtgggtgttgtctgcttcatcgacttttccgtcgatagtcaggaagtcaacatcttctctattcattcccgcgacggtcagatcgtcgaaatcggtcgtaatggcgctgtcgctgccaatcagcgtgtaggtgtatgcctcaggcgtccagctgtctgtaacgctgccaatgccggtaacattcagcgtgccgcccagcgcgacgctgtcggcggtaatcacggcgtcgtcggtggccgcgccgaggtcaatacttagcgtactgccgtcttcctgggtgaactggcccgcgtcaagggtgctgcccgctgccagcgcggtagtggcgccgctatgggtggtgacgttcgcaagctcaaatgcgccgttggcatccagtatcagcgtaccgctgttgtcgatattgccgctgcccagcgcgttgacgttggcggcaatcagcgtgccgtcagtgatagtggtggcgccggaatagctgttgtcgccgcctaacgtcagctcgccggtaccggttttgaccagcgaaccgctgccggaaagcgtattttccagctcgccctcaccgacctgaagcacaccgctgttggcaacagctccggtacccagcgaatccgcatggtcagccgtcagcgtaccgccgataatggtggtgccgccggagtaactgttatcgccgcttaacgtcagttcgcccgtaccggttttgaccagcgaaccgctgccggaaagcgtattttccagctcgccctcgccgacctgaagcacaccgctgttggcaacagctccggtacccagcgaatccgcatggtcagccgtcagcgtaccgccgataatggtggtgccgccggagtaactgttatcgccgcttaacgtcagttcgcccgtaccggttttgaccagcgaaccgctgccggaaagcgtattttccagctcgccctcgccgacctgaagcacgccgctgttggcaacagctccggtacccagcgaatccgcatggtcagccgtcagcgtaccgccgataatggtggtgccgccggagtaatcgttgccgccgcttaacgtcagctcgccggtaccggttttcaccagcgaaccgctgccggaaagcgtattttccagatcgccttcgcccaccttaagcacgccgctgttatcgatatcgccgctgcccagcgaatccgcatggtcagccgtcagcgtaccgccggtaatggtggtgccgccggagtaagtgttgtcgccgcttagcgtcagctcgcctgtgccggttttcaccagcgagccgctgccggaaaggatgttttccagctcgccttcgcccaccttaagcacgccgctgttgtcgatatcgccgctgcccagcgaatccgcatggtcagccgtcagcgtaccgccggaaatagtggtgccgccgctgtagttgttatcgccggtcacgatcagctcatcgctaccgcttttgacaatttggccctcgccggtcacgttgttatccagcgtgccctggctcagcgcaagcgttgcgctttctgcaatcgtcacatcgccagtgccgagcgcggcggcgtctttggcggccagaatgccgccgtcaatttcagtatcgccgtagtcgttgccggtgttgctgaggatcagcgtgccgtcgccttgtttggttagcttgctgccgttccagttggaggtcgccgtggtttcgtccagttcgctggtgacggtaaaggtactgcctgcatcaacggtaaaagtgccatgcgcagcgcgcgcagaatttgcgcccgcgtaccaactcaagcccgtagacaactcgtagttggtattatcattcgcatcaacgcccgcgttgatcgtcagataatccggcatagcggaggtgtcagcatccagtgttacgctgtcaaaatcggtagtgattgcagtttgcgaatcaatcagcgtgatcgatccaaagtgttcgtcggtttcgggcgcgacaaaggtggccgttgagctaaggttcagcgtcccgtccagcgtgacgttggcggctttgataattggcgcgctgttggcggtatccagcgtcgcgtttatctggctgccgtcctgcaaggtcagggtattgtccaccgtcagcagcgtacctgtcgaaccgctcgcgttgcccagcgtaatatcgccgtcgttggtcagattgccgacggttgacgggtcggtcatgttccactggctggtgtcgtcgagcgacagcgtagtaaacatcgcatctacactaccggttaacgtggacccctggcttaaagagagcgatgacgatgacgcgtcagtctggacaatgttgccggtcagcatcgttttttcggcctgaatagtcgctttgctgcctaatttgatcgcggtcggcgccgtaaaggtgctgttggtgagctcaatggggtcgttaatggtcgtgctgccatcaatgttcagtgcgacagtttttgaggtgacgtttgcgtcgctgaccgtcagcgcgttgagatcctcatacccgtcgagttttcttttgctggttataaagataccgtcgccgtcggcgttgatggtggcgccgtcgatcctggcgtccgacgccagaatatacacgcccgtaccggcagaggtaatgttgccgcctgtaatatccagggtagtggcgttattggcctgtaccgccgcgccgctggcattggtatgtgttatggtcgcgttggtgagattaagagcggccttattggtaccctggatggtgctcatcgtacctgcagagctgaccgagctatcagacaggttcagggtggaaccctcgtctgtcgcggtgtttccggcaacaacgtttatctggccttgcgccagggtgattgtgctaccgtccagcacgttcagcgtactgccttgttgcacctgcgcgctgctgctgttagctgcctcaacgatggtaccgtccagcgttgcttctgaacccgtatacaacgtcattacgccgaaattgccgtcaatcgttagcgtactgtctgttaacctcagtgtgctgccatccgctgcggaaataccctgggtataaatacccgtagtggttatcttcgcgtcggtaagctcaaggatagcgtaatgatccagcgaaatggcgttggaaacatacttaccgccatccggatcatcagccccgcctccgcttgtttcaatgacgagccccgtccctgtgaccgtggtgggctgccagccgacggtggcgacacccgagacatatagcgccgcgccttcatcggtgcccgaatagcttatcggcggcgttgacgcatccagaacgtggggctgcgcatcagcatatgatacctgattatcggccatagccagcgggctgaaaaatccgagcgccgcagccacggcgcaagccagcgccgcgcgcgttgcttttattatttgtccatattcggacttttggtttggagaatgggtttcactcgcgcatacttgcgctttaactttgctgtggcctcgcgccagttctgaagccacgacatacatatttcgcacggcgctccagacaatactgtaagtcctgttcaatttttaaatttccctttaataacgttcacgaagcaaactggattttgattgggctgcaaatagcctttaaatgctacattatcaatgagttaaataataaataacaaaaatacagctctatgaatggttgcaatcacctgaaacaatatattatccaagccaaattattaactaatttcaaggcttatttcaatgccaggtcaatttctggttgatttataattgatataaatacattcatccatttaataaatatttatatcgtgaataacatttaataacttcatatattgaaataaataaatgcgtgaaacaaaaaggtgtgattatcatgcgacacctggcgttattttaaatatactcgtcatacttcaagttgcatgtgctgcggctgcgttccctcaccccagtcacttactttagtaagctcccggggattcgctcgcttgccgccttcctgcaactcgaattatttagagtatatacgtagcgccagatgccgggttgcagaagggagacggcgcttttacacacgcgtggcaaacggtggtgacgccaattagcagaacatatacttttcaatgaatgctactttcactttttcatgaagctcaattgaacgtgaaaagcagattattttcgtgccagacgcataatacgttactccacgcacgtcgcataacccgctgagcctgccggcttaatggcgcagttttgactcttggtattctcatctacgccgcaatacatgccgccgcttgaggttgatttagataaatagggatagccctgcgtcggccagcctaacgagctaattgaatgatacagcgtcaacaggtcgttattatccggtgctttgctaaggctaccgcactgtttggcaatatcccatttcgtgttgtccaccgtatgcgccatcgcccagtactcgttatttgcatgcactccgttggtaaatactggcgttacgcctgacagcatctcagcctgaagccacggacgatgcagcgtttttccgttgacggatgtcgtatccgacatatttccccagaacaacgctttatccgtatccgggctggtaagtaccataaaaatcacatccagcgatgcgtgaagagtcgtattgtccgtcactttcaccgtgagtggcgttttcaaccccaggcttttatcctgattaagcgtaaacgttgccgtaccgtcgctgccggtagtgccggtaaagacaatcccggtggtggtcatactttggctggcgcttgcgggagtcagctctttaagcatgagatcgtctgctccggcatccgctgccacgtcgccatccgttatcaccatacctgcccgatttttcgaatcgccacgtgacaacgtaaaaccgacgttggcgaccgggttaccgctgctatcttttaccgtcaccgttaacggcatcgcgcttcccttcgccactaccgccgcatttttcgcgctgtccatcgccgtcgaggtcagcgtaatactggcaggagtagaagtacgcggctcgaccagacacacctgagcgccggtggcagtcgatgaactggcggtgcccttaccgccgctattcaggtttataaattggtaatatccggtattcggcgcacgatccgccgcccaccaggatttgttccccgccaccggccagccgtaatttgtaccgattgcgccgttaggattgtcgctatacaacgtttgcagatcgcccgacaacggctggtattccgcatcacagccggttgcgcccgctttttcagtgttcgctgcggtgactaagggccatgtttcattgttaaccaggtaagtaccgctattcgacgtcatctccgccgccagcagcggacgccggaacttcacgcccgcgctgttggttacggtttccggcatgtgtccccagtatttagctttatcactgtccgggctggtaatgacggtgaaaatgacgtccatatcgctaactgtcagcggatcgtcgacaagcatcgcctgtagcggtgttctcaggccacgggaatcatcctgcgtcacttcgagttgcgctttaccatcctcatccgtaatgccataccaataacttgtgcacgaagataccgtgcagttaaacgtcattgagcccgtagacggcgcaaccgatgtgagtaccatgcctccgccggaactgccatcaacgacacccgcccggtctatcgaaagcgttcgtcccaaacggatagcggtattgggctgcggcgtgccggaaccatccctcacagtgacggtcaacggcaggctctcgcccttcttcgccactggagcgcctttatccgcatccatgtcgctggaggtgagttctatcgacaagtcccggcgctttgccagacaaagctgcgccgtggcggtattggctttggttgtcagcgtattattatcgctgagtctgacatactgaaactgactgtctgagtgcgtggcatccggtactgagttacccgccccccaatattttcctgatgccaccggtaggccaagcgttgtcgtgagtgcgccattgggataatcggtatatagcgtctgtaaatcatttaccgtcggcaaccccagccgatcgcacgggctggcggtgtcctgatacatattcggataacggctccaggtataccaggtctcgttattttccgtataacccgacgtgtccgccgttgaagaaagttcagcgcgcagcagcggtcgcttaaattcaacccccttactgttggtaaaggtttccggcatatggccccagtatttggccttatcgctgtccgggctggtcactacggtaaagattgcgtctttgctgtctgtcaggttgctgccgtccatcgtggcggcgctgatagtggtttttaaaccggcggtactgtcctgcgcaagggtaaatgtcacctgtccctgggcatcagtttgcgcatacagatatttcgccgaggtatccagcaggtatgtcgccaggccggacggcatcacattacgcagcgtaatatcgtctgtgatgcttgaggacgatgtggcgctgttggcgcgattgtacgaagatccgcggctgattttcaccatcacgtttttcatcggctgacctgcggcgtctttcacgtcgatggtggcggccatctgctcgcccttcttcgcctttgcgcttccggtggtttcatcctggcctgccagcgtcagcgtcaggctggcggcggcgctgcgcggcgaggcaagacaggtctgcatgtagtacatcgaggtgctggtcgtcgttttgacatcattgccgtcgttaaacaggttgaccgccgcatagagcgacttcgtgccgtctgacgatatcacgtaatcccccgcccaccagtagcggctgacgttgttgttgcctgaactggtcatcggccagccgttacggctgcgcatggcgttatccgggtatgtcccgtacagtgtctggaggttggctacggtcggtagcgtgtcgcgcccacagccgccaccggtgccgttccaggctttatcgacggttatcatgccccaggtttcgcctttgtcgtagtagccgttggcgatggtcagcgttttgccgggcgtagcgctaaactcgctggccagcagcggacgcctgtacgccacgccgctgctgtcggtcagcgtttccgccatatggccccagtagttggccttcggcgtgtccggactggtgaccacggtaaagatgaccggcagcggcgcgctcgttacgccgttgtgttctatcgccgccgtcagcggcgttttaaagcccgcgccgctgtcctggctgatattcagcgtcagtgtgccgtcggcgcccgtggcggtgtaatagttagcgccgctgctacgcccgtcgctgtggtttatctgtatatccgccgccgccgagctattcacctcctgattcgcgcgcccgacgctgtcgccgcgcgtaaagataaccggcgtgtcggcggccgggttgccctgggcatcccgcgtggtgatgatgaccgggatggtctcgccgactttcgctttggcgaatccgtcgctgtcgttatacacaggcgaagtgagcgttatctgcgtcgccgccggatgggcgttttgcaggcagacaaaatagagttgttcattccacaatagcgaaccgacgccgccgtcgcgcagattaatcgacttaacgtagcggttttgcgtactccggctcaaatcggcggtgctgtcctggtagtttttaccgtccagcggccagccctgctgcgtattcatggcgccgccgggcctggcgtcgtacagcgattgcatatcggcaagggtcggcacgtatcccgcgccgcaggcgtcgttcgccatttcaaaatcgacgattccccacgcttcgttgttttccgtattgtcgccgtgggtaacgccgctggcgatttcagccgataacagcgggcgcttaaacacctcgccgttggccgccgtcgtcgtttccggcatatggccccacattttggctttgtcgctgtccgggctggtgaccacggtgaaaatagtgtcgatgctggccgtcgcgctggcgttgtcgtacagcgccgccgtaatcgcgactttcgtcccgtgggtgtccgggcgggtgacgttgatgattttgctgccgttttcaccggtcatgccgccgattttggtggcggtgtcgttgagcgaatcgccgtcgatcaccaccgccgagacgatgccgtcgccgctaccggcgatatgtttctccccctggcgggtatagccgtcgccgcggcttaacacgaacggcgcttgcggcagcggattgccgctggcgtcttttaccgtcactttaagctggagcgtatcgccctttttcaccttcaccgcgtgttcgctgtttgcgttataccacaatgccgcatccaccggctcaatggtgatagacgccgccgtcggatttttgctgaccagacagctcacgtagtccgacgcatcgccggaagcggtatagccgcccgcagccagtgataccgcctgccatgtagcggcgctggcgaaggtggatgaccagtagtcatactcagtcggccagccggatacggtgtggattttattgccgtcgctggaggcatacagtgcggcaagctgatcggcgcgcggcagatggccggcctcgcagcccccggcgttggggttattcagcgcgtcggcgtggctgacacgcgcccaggtttcgttatcctgctcctgggtacgggtggcggcagtcgcttccgccgccagctttggccgctggaatttcatatcacccacggtgagcgtgtccgccatatgaccccacatctgcgcctccggcgtatcggggctggtggcaacggtaaatttcacgctgcggttgacgggcgtggtaatcagtgagttgaccggcagtacgctcagcggcgtcagcaagcccacgccctgcggctgttcaatcaccagcgtggcgttgccctcggcatcggtcatgccctggtacgtcatcgacgcctgggaagagccgaaaggcgttccgcccatcaccagcgttccgtcgctgggatcggtaaagcccgtggtggcgttgtcgcgatttttgccgtgcgacatggtgacggtaaagctggcgttaggcacgcttaacccattcagcgcattgacggaatggacgttcatcgtgatttgttcgccgactttggctaccgcattgcgtaacgactcatcgccattaaagtaaacgtccagactggtcaccaactcattgccggagcaggagagatagttcggttcggtgccgctgaacgtgctgtccgcaccggtcgccaggttgacgtgcgcggtggtggaaccatcagtatccgccgcgatatagctgtgtttctgcgtcggccagccgtaggtcgtttccatcgcgttgccggaatgggcctgatacagcgtatccagcaacagttgccccggcacctggccggtaccgcactggttcgtcgccgccgttaccgagttaaacgtcgcccagtattcgttattctcaaattcggaaccggtatcctgcgcggcttcgtccgccagcagcgggcgtttgtagatattgcccgcttccaccacgccctgcatatggccccacatgcgcgcctgcgccacgtccgggctggtgacgacggtaaaaatcacgttctgcgtcgcttccgtgccgtcgaacagcaccacgcgcaccggggttaatacgcccgcccccttgtcctgagtcaacaccagcgagaactgaccgttggcgtcggtgacgccgtgatagtgaccgtcgctgccttccagattggtgataattaccggatcatccgtccactgatgcccgctatcaatatcggcgttcttttgattctggcgattttgctcgtcgcccaggtagacgttaaagtagcgataaggcagcggtttattggtggcgctgtcggtgacggtgatcttcatgttgatctcttcgcccaccttcactttcgccgcgttgaccgttgaatcaaaattatcggcgctaatcactaatttcggcgtgaccgcaggcggggctttatccacgcagctaaccagcgattgcgtggcgtccggcatctgcgtaagggcgcggctgcgcatatcaatgctgatatggtcagtggcagtcgatccctgggaggaggaccagtactcttcgtcaccggatgtcagccctaccggccagccgagggtggtggccagatcgccgcgcgcaatttttaacccttccagttggcgtgcatccggcagaatatcgcagtgcgcgtcggcgtggccccagttgaactgcgcccaggtttcattgttgatgctggcggtgcggtcttcactgtcggtttccgccgccagtttggggcggtaaaaggtgtagcttgcgccgtccaccgtggcggtggacgtctctgccatatgaccgtacatgttggcgctgctgctgtccgggctggtgagggtggtaaaaatcacgtccacgctggctttcagcgctggcgcgctcgacgggtgcgctatcagcggcgttttaacgcccgggccgttcgcctgggtgacgaccacggtcgccacgccctcggcgttggtcgtaccgtgatattccgtggcggtggtggtcagttcggtgttgccgacgcgcaccggcgcggcattgtttaccacgccctggcggttttgcgcgtcgccgcgggtaatcacgaaatcaacgttgccctccggttcgccgccgcagtctttggtcgttaccgtcagcatgatgctttcgcccgctttgaccttcgcggcgttgagcgactcatccagatgatcggcggcgagcgttaccgggtcgcccacggcgggcgcgatatccacggcaaacttttgatcaagcacttcgaccgccgtgttataaggcacgccggtgcgggtaagcaaccacagcggcggtatggcggttgaggtatccagttgcgaccagaccaccagatggcggcccgccagattctgcgcgcagaaacttatattgctgacgggttgtggatcaagcggcgtgtccggcgtggcggcgtcggcccacaccagcgtaacggcgggcgcgcgttcagcctgccaggccagcggcggcacggcgaagatatcgccttcggtgtcgtgcggattggttaaggtcagcgcgctgccgacatcactggtgctgaactggctgggcttcgcggagtagtcaacaggattcgccgcatcagagcgcaactgcacgctgccctgatataccgggatcgttacactgtcggcctgaggcggagtgccattaatagccgcagtttgctcagtgagttcctgccatgcgccgctgcttcgcacggcctgcgcgaagaaaggcgttaaactgagggcgcatagcagcagccagggtaaaaaaccgacacactttttcgatttcactgacgtacctgagaaaagtccatttcgttgcagttcattccatgaatacaaaaacgtaaaaatacatcgctaccggaacagcgccagctacaagggatacccaggttgggcgccgcaaagcgtcacccaacattcaaacgcgctcccggccccattccccattcactacggcacccggcacgagcctaagcccgaggtcgtcgctttttcacgagtacaggttgtctggccggtcgtttcgttaaatgaacagtagtacttattgctttgaccttcatcttgcgacacatagtcccaggatgatgtcgtcggccattgcaacgtgccgataacgctctgcaacgctttcagatcgtccagcgaggctatattttcctgcgatccgcaaagatgcgtcaacgacgtttccacgtgttcggactgataataatagttcgtcccccagaattcattattaaacggccaggtatcccggggcgcggcagagagctcggctttcaggtacgggcggcgcagcgtaacgccgttcacctgcacggtatccggcatatgaccccagtatgacgcatacggcgtatccgggctggtttgtaccgtaaagattgcatctacgctcgccgcctcatcaaattgattcgcaagcgccgccgtgacagacgtttttaaccccagcgatttatcctgagttaacgtaaaccgcaacttaccgtcatcgccggtgaagccagaccattttgtgctgaggccattctggttattaaacgccactgccgtacccgcaggtgcaaccggcgccagcatcatattcgccggcgaagttgtaaacggaaccggctcgccaatcacgcctggttcaatgtattgcttatccaccgcaccgcgcgaataagcgtaatcacgcgtcaacagtacggccaccccggcctgcggctgcccggcgtcgttagtcaccgttaccgtcatcggtatcgtttcgccttttttcgccacggccgccgatttatcggcgttccatgcgtcggaagagagcgcgatattcagcccgctgcgcgatgttgtcaggcagagttgtaagtagtagttacccgggttttccgacatgctgtagtttttccccgtcttgagatctttatactgccagtaaagggttgagcctttcagcaggctatcccccgcccaccaccgcttcccgacgggcaatccaatatcggtcgccaccttgccgcttgggtgatcgttgtacagcgcagtgaaatcatctatcgcagccatctggttcatcggacatccgccgtaattaccggtattaaaactattcaccatgatccagttttcattggtttcgaaataggtatccgtgtgcgcctccgatgagggctcgcctgccaccagcgggcgcttaaactccgcaccgttgctggcggtgaaggtctccggcatatggccgtacatgttggccttgtcgctgtccgggctggtgaggacggtgaacaccaccggcagcgatgaggtcgccgtcggcgtatcgttcagattcgcggtcagctggtttttcaaccctatgccgccgggttcggcaagcgtcagggccagcgtaccatccgcgccggtggcgccggtcagaaccgatgtggcatagtaaaactgttgctgcgcaccggtgagcggcgtcaccgtcatgttggtgccgttagtggctacaaatttattatagtcagggttgcgcgccttcccggcgtcacgtttaagcgaaaaagtcgcataaggcaccgggttgcccatcgcatcggtagtggtgatgagtagcgggatcgactcgctgtttttcgccttcaccgcctgaatagcgtcatccatcgcctgcggggaggtgagggtaatctgcgtggcctgcggcagcggcgtcgtggcgcaaatttgatactgccaggcagtgctggtcgcgctgttttctgaccgacgcgaaccatcagccagatcgactgcgtaatagaagtcaagttttgccccgctggaaaatgacgtcgagttcgatccgctccagtaagaatagtagaccggccagccctgggcggtatttatcgttcggctcgggtatttgctgtagagcgaatccagcgcctcaacggcagggtaatagcccgccgcgcaacgggccggattggccccttcactggctggcccatgaaaaaccgcccaggtttcgttggtttcttgcttagacgcagtattgtccgtactggacagctcagcgtacagcagcgggcgctggtacaccgcgccatccgccgccgtcagcgatggcgccatatgcccccacatgcgggcaacgctgacatccgggctggtgacgacggtaaagatagtgtcgatgctggcactcacggcggcattttcatacagcgtcgcgttaatcgcggtgcgggtgccgtgggtgtccgggcgggtgacgctgatgatacgggtgccgtcagtgccggtctgcgaccccattttggtggtggtccatgccagcgattcgccgtcgatcaccacgggcgtcacgatgccttgcagatcgtcaccgtcctgagcggtatacttttcgccccggcgatcgtaaccgtcgccgcgggtgagcacaaacggcgcttccgggatcgggttgccgctgacgtccttcaccgtcaccttgagctgcatcgtctcgccctttttcactttgaccgcgtggacgtcgctgccgtcgtaccactgcgacggattgaccggttcaatggtgatggacgccgccaccgggttatcgctggccaggcagctggcgtaaatcgagacgttgctgttggcaaattcactgccgttcgtcagcgcgatcagtttccaggtggtggcgctctggtaggtggacgaccagtagttaagataggtcggccagccctgaatgctgtgaatcttgccgccgctgttggcgttatacagcgcctcaagctggtcgatgcgcggcaggcggttcgccgcgcagccgcccgcatccgggttgcccaccgcgtcgctatgggccacgcgcgcccaggtctcattgctctcgtcctgggtacgcagcgggttgctcacttcacccgccagtttgggccgctcaaaggtccagtcgcccacggtaatcgtgtcggccatatggccccacattttggccgctggcgtatccgggctggtggcgacggtaaacttcacgctgcgggaaaccggcgtgctgattaatgaatcgacgggcgcaatatttaacggcgtcagcagccccacgccctttttctgggtgaggataatggtcgcatcgccgttagcgtcggtgatcccgtgataaacctgcccggcaacgtagcccacgtcgtcaaactgcatctcgccgttgctggtatcggtaaagccggtcgtcagcccgtcacgccgcctgccgttcgccatggtgatggtgaagtcggtattgccgatcgccatgccgttaagggcgttgcgcgaatggatgttcatcttaacctgttcacccactttggcgtcggcgtttttgatcaccgggtcgtcgttgaagtagacgtccagcaccgccaccatttcattggccgagcaggtcaggtagttgggcgtatcggtaaatttgccgctatcgccgttttcgaggttgacgtgtaccgtcccggaggcgtcgctgtcggcggcgatgaaataatcttcagtcggccagccgtgctcgctttccatctgtccgcccgcatgttcgctgtacaaatgcgccagcgacgactgatccggcacctggccgacaccgcactgcgcggtggccgacgccacggagttaaacgtcgcccactcttcgttattttcgctgaattggccgtctttatggctggcctccaccgccagcagcggacgtttgtacaggttgcccgcgtccaccacgccgcgcatatggccccacatgttggcgccgtccacgtccgggctggtgaccacggtgaaaattacgctaaaggacagctcgacgttgccgccttcgtcgtccggcatcacgatgcggatgggcgtttcgacgcccaggccgctgttatgttttaacgtcaggtgcgcctggccgttgacgtcagtcacgccggtatagtgctccggcgacgaggcgctcataccttcggaatcaacggtgacccgcaggttatcccatgcgtcctgatgttcccctttgcggtttttcgccgggtcgataaacagctccatgtagcggtaaggcagcggtttttgcgtgtcccggtcaactacggtcatcgtcagatcaatcgactcccccacctgcgctttatacggtccttgtggggagagagtaatctgcgggtgcgccgcaggctgggctttatccacacaactgaccagcagcgtgtcgctgtcggcggccctgacgaccgatgcgctgttcatatgtacggcagcgtggtagccgctcagttggtttttggtcgatgaccaatattcagcatcgcccgccaccggccagccggtccaggtttccagcgtgctgtgctcatgtcgcatctgcaccagctgttcggcgtccggcagaatgtcacagtggttatccgcgccgctccaggtaaacagcgcccaggtttcgttggtatcgacgacgcttttgtcagcgccgctcgcttccgccgccagcttcgggcgggtgaaggtgtaggttataccgttcagcgtcgcggtagcgctctctatcatgtggccgtacatactggccttatcgctgtccgggctggtgatggtggtgaaaatgacggcggtttcagccgtaagcgccggaaagttgaccgagctgacaaccagcggcgttttgacgccggggccttccttctgggtgaccaccaccgtggcgttgccgttggcgtcagtgacgccgcgatattccgtttgggtggtcgtgagctcggtatcgccaacgcgaaccgggttggcgttattgaccacaccctggcggttttccgcatctttacggcggatgacaaacggcgcgttgccttcgggcgtgccgtcgcacgctttggtggagatggtgagggtgatgctttcccccaccttcacttttgatgcctcaaaggccgaatcaacgtgatcgccgctgactgtaaccggcgtgtcggtggccggtttaatgttgagcgccactttcgggcttaacagcggaatggtcgcataattcggcaccccggtacgcgtaaagagccacagcgcgggaacgttggtttcatcttccacctgcgcccaggccaccagctgtcgcccggcgaggttttgggcgcaaaaggtcaggttcggaaccggctgcggcgagagcggcgtgtcgggcgtggcggcatcggcccataccaggcccatggcgggcggctggcggttttcccaggcgatggtgggcggatcgctaaagagatcgccttcggtatcggtggaattgaccgcccgcatcgaggttgaggtagcatccgcgctaaaatcgcgcggcatggcgctgaattcaatatcgtgggttttgctcgggtcaagcagcgtacttccctggtaaagggggataatagcgccgtcggccagcggcgcggtgccgttaaccgcaccggtgactgagttcagctcttgccaggttccgcccttcaatagcgcctgcgcaggtgcgatcgacactgcaaacatgatcagtaatgtcagtaagaaatgtacaactttattcacttgccgattcctgtccatgagcgatagccacccgttttcattctctgtcgtaattcaacccactttgcttagcgcgcggctaagcaaagtgcgcggaaaataccactccccgcggggagtggtatgttgaggacaacttatttgcgtttgtagtcgatggacagaccaaagccctggacaccgtcgctacccacggtaacgccgccgtctgctccctcgaacgccgttttcgcttcggcgttggtgacagggatgacaaggtctttatcgttccagctttcgttgacgataccgccggtaccggtacctgcaattttactggtgccgacgaatttccagcggtagtcatactggtcggtaacgttttcaccggcatcataggtaccgttgccgttcttatcgctccacagcaatacctgataggtggtattcgttttgagtgtcgtccctgaattcttcaacaggttggtattcgaatctttctcatgaataaccacatggacgttttcatccaccaccggaccttccggaatttcgtcatcatccgaaccaccgcccgcatcggtcgacaggtctttcaacagcagttcggttgccacggcagggtcaccggtggtagtggttggcgtgattttgataccgatataacgatccgcatcagcggcctggatttcataactgtcaccagtaccaagatctttggggtcgctgccattctgatcgctaaagctcacccatttcacggtggctttagttgccgtgttgtcggtgtccaggtcgccttccgtatcgccaatcgcccagttcaccgtgaccttatcgccaacgtggaactgcttatcgccttcggtcacaattttacgatcgccgcgatcgatagttaccgttacgtgatctttgtcggtatccgcagttttatccgccgcacgggtaatccacggcaccgtaccctgaatggtgcccgtctgttcagagacaatctgccactgccccgatttcagattaccgtttgccgccaccgctggcgcggcgcaatacccggcaactactaatgctaaagcgaccttcgtcagccgccgttttactgttgcttgcattcagactctcctttttctcaaaattcagcggctggctggtcagccacaacgctgacgctatttctgactatacgtaacgcgtatgccgtaaccctgaacgccatcttccacattggcggcaaacttctgcgccgcctctttattggttactggcaggacaagatcttcattcatggtgttggccagcgcgccggtatgtccgtttgtactctgcccggtaaactcccactggtagtcgtacagcgccatctcttcttccgtgagctgctcggacatctggaatacgccgtctttatttttgtcgcgccacagcaggaaacggtaagcattattgaccgtagggtgcttatcttctttgccgataaggttgacagggttggcggctttgacctgataaatcaccgcattcagcgcgctcaggttgtcgccgataaaagtgacatcaacgtagttactgtcgccataggcgtctgctttcgccttccagcggaaagtccccggcagggtgctggaaagcgtcaccgtccccgcttctttgtcacgactggcaataaacacgcagggggtttccgtggtgcagggcgtctgggccagggtgacttttttatcattgctgtcgtacaacacgggcgtcatggcatcgtccaccagttcgttaccattgcgatccgtggagtcgccaaaggaatcggtgatcagcagatccatcaccacgccgtcttcgccatcggccagcgcgctggcttcatggctgtgatcgctgcgatcggtatcggcaatgttgtcgacgatcagctcaattttgcgatcctgctggacggtgatttccaccacgccggagttctgcttattgcccttttcatcttccagcgtcatgcgtactttccaggtgttcagggcggtgcgctgctcttcggtatcggcattaacccaggcaggaagcaccagattccagctgttattgttgccttcggttaacgcattagcttttaccaccggcatcaccagcgtacgggcggcgttgtttttcgcctgccaggaggcagaaataattttgtaatggtggttaatcagcgcgttgacagtccatttgcacttttccagaccaacagcggcctcaggcgtatcttcaatcacgcattccgggtgttcattggtggcgtcagccttcagccacaacgtgacgtccagcggatctttctcacgatattcgagaatgatgaaattgttacgatcgacaaaatcggtgcggctgcccattaaggagtgctgaattttaacgttttccggatcgagctgcgccgccagcggcgtgcctatctggtagttcacggtcgcgttaacgctaaagtcgttactatcgccagtaccggctttgtaatccgtaccaaccgtgaccagcggtaccggcgtatattccagccccaaagtgacggcatgaggatctttttgcagattatcggtgccaaacagcgctacttcatcgccgtagtactgttcgtaaactaatttagcgccaagctgcggataaaacggcagccagctttccatgcggatatcccagccgcgcgcgggtcgttcttcataaaagtcgaaatcttcggagtctttccagtcagaaagaggatggtaatagttgccggagaatttcaggtaatccgtccaggcttcagttcccagacctaatcgacggtgaccgcgcgtaaaatcgtagtcatagaatgcgttgccgccaagcagccagttgccgacgttctggcgaacgccaagcccaaagttaccaatggtgcggtcttccttacgctgagccgaaatctggctaaagaaaagcgtgctctggttgtcataccagggaataaaataatccagcgaactgccgtccagatcgccgccttcgcccacggacaggctggtacggatcttgccataaggtgacattacaccttcaagatatgactgtgctgaggaagtgatttggttttgcaaatagctacgcgcctgggattccagcgcttccggggtgagattatcaaagccctgggtggcggaattaataaagtagtcagcgccctgttctttaaaggactttcctttattttcctgttcttcttttttcgcggattcgctggctaaatcaggcagggaggagtggctttcatcatttgcagatgcagagttatctgcgccagaagccgcaactgagactccagacactaatagcaaaaccagaatgcgaatccttcgcaccatatgatatccctgtcgttaaataaaaacgcctctatgaaaagatattatatggatgattcagatggaatcataactaacaggcctaaatatattcctaaaaagaaaagtttaatatgaaacagatttataatattgatataataaataaaaagaaagctgttatttatttctaatattaattttcgggaataatattccctataaatagttgaatcaataaaaagaataaaataaccgccgggcaggatactatgctgatattacgggagtatcgaataacgcttttgcccttagccggataagacgtcggcgcctctgctctgcggcgcaacgtcgacagcggttttattgatcggaaatgacgaaattaacccgtttttttgaaattaaaccatgaccgttctggcaaaaatagtccactgcgccgcaggctttcaaaacctgtaacggctggcggcagtcaggacaaagtgcctgtaacgagaaatctttagcgcatgtctcgcaatgcgctgtatcgccattgcgctccagcgcgtgatggcaaacggggcaggttatttccataacattctcctcaggcgcgtgacttacttttacttgaaaggcctgatagcgcagcgcttgtcaggcctggaatattactgaaaaagcattacttgcttttcttgatatgtttcatcagacgcttacgtttgcgcatttgcgttggcgtcagtgtgttacgcttgttcgcatacgggttctccccttctttaaactgaatgcgaatcggcgtccccatcacttccaacgacttgcggaagtagttcatcagatagcgcttataggagtctggcagatcttttacctggttgccgtgaatcaccacaatcggcgggttatagccgccagcgtgggcatatttcagttttacacggcgaccacgcaccagcggcggctgatgatcttccaccgccatcgtcatgatacgggtcagcatcgcagtgctcacccggcgagtggaactgtcgtaagcctcgcgtacggactcaaacaggttgccgacgccgctgccgtgtagcgcagagataaaatggacgcgggcaaaatcaataaagcccagacggaaatccagcgtctctttcacctgctctttgacttcctggctcaggccatcccatttgttgactacgataacgagtgagcgcccactattgaggataaagcccagcagagacaaatcctggtcggagatcccctcgcgcgcatcgataaccaacagtacgacgttagcgtcttcaatcgcctgcaacgttttaatcaccgagaacttttctaccgcatcggtgatttttccgcgcttacgcacccccgccgtgtcaatcagcacatattcccgttcgtcgcgttccatcgggatataaatgctgtcgcgagtggtgcccggcatgtcgtataccaccacgcgctcttcaccgagaatacggttagtgagtgtggacttacctacgttcgggcgaccgacaatcgccagctttatcggcaggctttgcgggtcaaaatcatcttccggcgcttcttcaccattttgttccgcctcgaactgcgcccagtattccgcgtcttcatccacctcttcctgcggcgcgacatcatccatccacggcagaagcacatgttccagcaggctcaatacgccgcgaccatgtgaggcggcgatagggtaaatttcgcctaatcccagcgagtaaaaatcgacaaccgcctgatcgggatcgagaccatccgttttattcgccaccaggaaggtcggtttttcacgggagcgcagatgtttggcaatcgcttcatccgccggcatcagaccagcgcgcgcatctaccatgaataacaccacatccgcttcttcaatcgccagcagcgactgttccgccatccgcgtttcgacgccgtcttcggtgccgtcaataccgccggtgtcgatacagataaactcgcggccttcaacctccgcacgaccgtacttacggtcacgagtcagacccgggaaatccgcaaccagcgcatctcgggtgcgggtcagacggttaaatagcgtggattttccgacgttagggcgcccgacaagcgcgaccacaggtaccatgtttaaagcctcatttaaaaaatcatcagacaacgcgcgtcatttttacgccgttgttaaaaacaggaaaacggcccctacaccaggagccgttttttaaaacacacaaccgtgacgattaacgcgtaatcgcgtagaccgtaccgtctttggcctggatgagcagtttaccatccgccaccgtcggttcggtcagaaaaccggaactgtctactttttgttgggccacaaaacgcccgtcatcgacattaatccagtgcagataaccttcgctatcgccgacgactaaatcaccattatacagcaccggggaggtcagcaaacggtgcagcaaatcgctttgcgtccacagcgttacgccgccgtcagtggtcagcgccagcacgcgatcgttctgatcgaccaggtagatacggtctccgtcgacgataaagtcattgaccgaacccagctcgcgtttccacataatctgaccactgcgcagatccagcgccgttaagttaccattatacgccaacgcgtaaacgacgccgtttaccacaaccggcgtggtatcgacgtcgctcagacggtcaatttccgttgggccagtggcctgggagatacgctgctgccaaatcatctgcccttgttgcatcagcacggcgctgacgcggccattatcaccaccaacgatagccgcgccgaacgcggttgccggcgcagattcgccgcgcagcgacagcgaaggcatatccaggttcaccgtccatttaatggcgccatccgcctgatttagcgcctgcaactgaccgttgctggtatggataagaacgattccatcactgacaaccggacgagacaacgcttcgcctgcgaccttcgtctgccatgctgtggtaccgtcgctggtattcagcgcataaacctcggccttttcactgccgatatagacgtgaccgcccgcgacagtgacgccgccggacaacaacgcggacgaacgagagaaccagccgtctttctcgcccagattcacagaccagatctctttgccatcatccgcattgagcgcttttaccacgcccgcgcgatcggctgcatagaccacgttatctaccattaccggatgaaggttagaataaaattcgccaattccgttaccgacagaggtgctccagacagtggtcggggtaaactggttttcaacctgcggtaatggagacatcttgacgacatcttcttcgccgctaaacagtgaacagccgctgagcagggtaacggaaagcaaccctggcagaagtaatttacgcaattgcatcgggtccctctcagatggacaaattattgattttcatctgcatcatttcgctcaacgccggagaagcatcgctattgacgcccgcttcccatgcgctgcgcgcgccttttttatcacccttactcagcaacgcttcgccgcgcaaatcagcgacaatggctgtccatccttcgcctttaacggcatccagagttttcagcgcggcgtcggcttgcttaagctgcaactgaacgcgagcgagacgcagattaatcaccgctttgagattttcatcgctggtggccgccaacccctgctgcaactgggcttcggcttttttaagttcattcttatccacaaactgctgcgccagttccatagacgccagcgcaccataggtgtttttattctcagccgcgaatttttcagcggcgggaatgctatccggcttatcggcgcttaccgccgtcaccgcattttgatacgccagagaagcagcacgcgcggactccgtctgatggctgctccagtaacgccagccaaccagcgcgccaacccctaaaatcactccgacagccagcgctttgccgttttcggcaaagaagcgtttaatcgcatccacctggtcgtgttcgttctcgtaaatttccacgctgtccttctccttagcccaataaagtgcgcaaatgcgcggcgacgctgtcctgcgccactgccgtttgctcaccggagcgcaaatccttcactacaacagtcccatcggcgacttcagattcgccaagaaccagtgcaatacgggcgccccacttatcggcgcgggcaaactgtttcttaaagttgccgccgccgtggtttgtcattagcttcacgcctggcatttcatcgcgcagccgctccgccagcgtcattgccgcagactgcgtttgtgcgccggcagccaccaggtatatatcgacaacaggagaggcaataaattccggattaactgcctgaactaacaaaacaagtcgttccaggcccatcgcaaagcccactgccggggtagcgcgaccgcccagttgttccaccagaccgtcataacgaccacccgcacagacggtgccttgtgaccccagactgtttgttacccattcaaatacggtgcggttgtagtaatccagaccgcgtaccagacgctggttgacggtgtaggcaattcccgccgcgtccagcaatttacacaggccggcaaagtgctcgcgtgaatcgtcatcgagatagtcgccgagagcgggcgcgtcgttgagcagcgcctgcacgtccggattttttgaatccagcacgcgcagcggattggtatacatacggcgtttgcagtcttcgtccagcgtctcttgatgctgttcgaggaacgcgaccagcgcatcgcgatagttcgcacgcgcctctaacgaaccaatagagttcagctccaggctaacgtgttcagcgatgcccagcgcgcgccaccagcgtgcggtcagcataatcagctccgcgtcaatatccgggccttgtaagccgaagacttcggcgcctagctgatggaactgacggtagcggcctttttgcggacgctcatgacggaacatcggcccgatataccacaaacgctgttcctgattgtacaggagaccatgttcgatgccggcgcgtacacagcccgccgtaccttcagggcgcaatgtcaggctatcgccgttgcgatcctcaaaggtgtacatctctttttcaactacgtcagtaacttcaccgatcgcacgtttgaataacggggtctgctctacaatcggcaagcggatttcactgtaaccgtagctgccgagcacgtttttgagtgtgccttcaatgcgctgccagatggcggtttcgccaggcagataatcgttcatgccgcgaatggcttgaatgttttttgccacgtttattctctttctgaatataaaaatgaaccctcagcgcttccccgaacgaaccgggagccatgcgggttcaatcatacacgggaagcgcgccgcttcccatcacgttcttatttttcaacctgcagcacgtcaatccgacgcgcttcatcaagttgacttgctttcgcgcgaatacgggattcaagctgcgcgatcatatcgtcgttatcgagtctgtccttacgcacgccgtcttcatacaggccgcttttcttattgccgcccgtcacgcccagcgtcgataccagcgcttcgcccggcccgttcactacgcaaccgatgatcgagacgtccatcggggtgatgatatcttccagacgctgctccagcgcgttcaccgtgccgataacgtcgaactcctggcgagaacaggtcgggcaggcgatgaaattgatgccgcgcgcgcgaatgcgcagcgacttcagaatatcgaaaccgactttgatctcttccaccgggtcggccgccaacgatacgcgcagcgtgtcgccgataccttccgataacagcagacctaaaccgatcgccgacttgaccgccccgctacgcgcgccgcccgcttcggtgatccccagatgcagcggctgatcgatctgtttagccaacaaacgataagactcaacggcaaggaatacatcggacgcttttacgctcactttgaactgatcaaagttgagacgatcgagatgatcgacatggcgcatggctgattccagcaacgcctgcggcgtcggctcaccgtatttttcctgcagatctttttccagcgatccggcgtttacgccgatacgaatagggatgtttttgtcgcgcgcgcagtccaccaccatacgaatacgttcttcgttaccgatattgccggggttgatacgcaagcagtcaacgccgtattccgctactttcagcgcaatgcggtagtcgaagtgaatatcggcaaccagcgggacgttaacctgctgtttgataagcttgaacgcttcggcggcgtccattgtcggtacagaaacacgaacaatatctgcgccaacgcgctccagcgctttgatctgattaaccgtcgcttccacgtcagtggtacgcgtgttagtcatcgactggacggcgataggggcaccatcgccaatcggcacattcccaacgtaaatacgtgtcgattttctacgttgaatcggagcctggttatgcatgaaaaacctcccgcgttacccgtctgttactgcgccggtgtcggttcggcattaagggtcagacgcgcaacctgattagttctgataaagcggctcagatcgacaggttttccttgatactggatctgcaccgcggccggcgcgccaattttaagtttataaggcgcctgaccggttaggtttaaattaccatctttacgctgcataccgctaaacagcttcttacccgtggcgtcagtgacttcgagccagcagtcagcggtaaaattcatcaccagcgcgttcggatcggcagcaggcgccgctacgccagcctgactggtcggcagcgcggacggcgtctccgttgccgctggcgcggcagatgtcgcagccgtatcgacattcgcctgcgaaggcgcgactaccgtattttgcgtcgccgccgccgttggcgctggcgtttgcgtcgccgccgtcgaatcaaccggcgtcgcaggagccggagccgtttgcgctggcgtcgtatcctggcttgtcgcggcaccggtgtccagcggtacgctttggccgctgtctttatctgcgttcagttcagccgtgctttgatcggccatcgtcgtgatctcttcctgctgcgccttgtggttctgccaccaccaggcgccggtcagccctacgaccacaaacagtaccagccaggtaaaagacattaaccagccgtcgcgttttttacgacgctttcctaatgagaaactctgcatcggggcgactttagcggcgcgcagcggagcttgtttttccagccccggcagcagttcctcttctggaacatgcaccagacgcgcatatgagcggatatatccgcgcaggaaggttgaagcaagatcggacggcgccttatcttcttcaatatcgcgtaccgtagaaaccttcaggcaaagtcgctcagcgacagcctgctggctgagtccgagttgttcacgggcattgcgcagacgaacgccggtggtttgtgcttcattttggtcgtgcgtggcttcagtattcattcgctacagctacaggtacgtgtaaattaggattcaggcgccgacgagccgtaatgcccgcccacaccgcgaaacatcaggttagttaaccttagtcagacagtataagcctgtcaggccgcagatgacaaaaccgctaagacacaaggctaaactcttgttgcaccattacatactgccttaaagtcgacaaaaacgcaccgttattattgaccagacaagtacaacgccagacattattcaactgacattgcgccacggtataatgaatgccccgtggcgcaactgctatcaaatagccttgatgtcaatcacctctccctgcatacgcttacgcagggtacgtttggtacggtcaatcacatcgccagccaactgtccgcatgccgcatcaatgtcatcgccacgcgtcttgcgtacgatggtcgtgaaaccataactcatcaaaaccttagaaaagcgatcgatacggctgttagagctgcggccatacggcgcgccagggaacgggttccacggaatcagattaatcttacaaggcgtctcttttagtagctccgccagttgatgcgcgtgttcagtgccgtcgttaacgtggtcaagcatcacgtattcaatcgtcacgcgcccctgattggcgttggatttctccagatagcggcgaaccgcgcccaggaacgtttcgatattgtattttttgttgatcgggacgatttcgtcgcgaatagtgtcattcggcgcatgtaaggagatagccagcgcgacatctatcatatcgcccagtttatccagagcaggcaccacgccggacgttgagagcgtgacacgacgtttggacaggccgaaaccaaagtcatcgagcataatttccatcgccggtacgacattggtcaggtttagcaatggctcgcccatccccatcatgaccacgttggtgatcggacgctggccggtgactttggccgcgccgacgattttcgccgcacgccagacctgaccgataatttccgatacgcgcaggttgcggttaaagccctgctgcgcagttgaacaaaacttgcactccagcgcgcatcctacctgtgaagagacacacagcgtagcgcggtcgtcttccgggatatagaccgtttcaacgcgctgatcgccgacagcaatcgcccacttgatggtgccgtctgaagaacgctgctcttcaacgacctccggcgcgcgaatttccgcgacctcttttaatttgccgcgcaacactttgttgatgtcggtcatctcatcaaaattatcgcagcaatagtgatacatccatttcatcacctgatcggcgcggaaaggtttttcacctaagtttttaaaaaactcgcgcatctgctgacggttgagatccagcaggttgatttttgtttctttgttaggaactaccggggtactgctttcaggtgtgacaatttgttcagacatatgctattccggcctcgttattacacgttatggcccctggagggttgaaaaaagaaacgccccggtaagcttactgctcgtccgggggcgctgcattgtacaaattctggcgtaaggatgccacgtctgcacgcggcattagcaaaaataatatttgaaccgataatttatcgccaacgcatttacagcgtgaaagacgaaggagattaacgggtgcgcgggcacacttcgccttcaccgaagaaaaaggcgatttcgcgctgcgcggattccagcgaatccgaaccgtgggtgccgttttcagttaagctatcagcgtagtcggcgcgcagcgtacccgccaacgcgttcgccggattggtggcgccaagcagatcgcggtgacgctgtaccgcattttcactttccagcacggataccacgatagggccagaggtcatgaactccaccagaccgtcaaagaacggcttgccgtcgtgctcagcatagaagccgcgcgcctgctcaacggtcaggtgcagcattttagtgccaacaattttgaaccctgcagcttcaaagcgcgcaaagatgctgccaataacgttttttgccaccgcgttgggtttaatgatggaaaaagtccgttcaatagccatgtttacctctgaaatatgttctgttgttatgtcaggcgcggattataaagagcatcccatcaattgcctatggatgcaggtaacatttttttaaaataaaatgagcattagcaacaaaagttaaaggcgcacagcaaactcaggggactgacacagcacgcagtgcgtgtgttcaggcgtgagagcatgaaaagtacgtttgcagatgtcgcaggtgagcgtatacgccgtactatgccgcgttgaggcgggttccacgtcaaaccgcagccgcagcgcctgatgcggacataccgccgcacagccgccgcatcccgtacaacgcgccgccgctatcgtcagggtattgtcgtcaaactggataacgttttccgggcagcttcgccagcaggcgccgcacatcctgcactcttgcggactgatttcgggtacgcattcgctgaacgcggaaaacgcctgtctgagacgccgtttccccggctcgacggcgcacggggtaatggcgtcgcgcggaacatgaaacagagtgcgccgcgaggcgttaatctccgcgccgacaacgtgtttgaaagaccagcccggctcgccgtagcggcgcagcgctaaatttagcctcgccagcgccatcagccactgcgccgatcgctccaccgcaatatcaataaagcgaataccgtactggctgtgccagagaagcagttcatcgaccgttggcgcctgtagcgaaaacggccccaccaacgtatccccctgcacaaagcgtttaaccggtttgataccggtaatggcgtcaacaggacagacaaacagacagtcgccacaggctatgcagcgcgtcgtatctatgctgacctgcccctgcgccagcgaaaacgcctgcgccggacaaacatcggcgcaagcgcggcaggaagaaaaacgaaagcgacgacggacgcaggcctgcgtcacgtctaccgccggatcgatcgtcaggttaaccatcagccaatactaaagaagacgtagcgcagcataatctcgccgagaagcagcaatacgctgcccgccaccagcgtccctctggcgtttcgcagaccgcctgcggcaaagcagagcattcccgccgctgagacacaccagccgagaagatagacgtcacgcaactgcgccagcgcctgtagcggatgatgcgggaaagtgacgaccgtcgtatccaccgcattaatatccgccagccatagcggctgcatgatcaggcgaatcagcaccatcagtgcgaccaccaccacagcgcagcgcattgcggcgccagcgttgcgcagataagccagcgcaatgactaccgagccgataatgcctgacgtgccaaagaacagcgccagcgtgttgctatgctgccaggtcgccaccgaggcatggatataaacctgcgccatgcagaatacatccaccagcccaaacgctgccgccagcgccagcagcggctgccagcctggctttcggaaaaacagcagcacaatccctagccccagcgccgccagataaaggctggcaaagacgatttcgcgactcagccacgaactggcgacatgacgtaacgcatttagcgcattcaggggatagcccatgtgcagcgctgaagcaagcagccccacgcaggccagtacaaacgcccccgccatcgcgggaagcgcgccgcgtgcaggcacgcgtccctctacggcgtactggcggcccaacgccagccacactgtcacgcccacggacccttgcaaacagagcgtaaaaatcagcagcggtaactcatgcatggcgtttaccctctttttctgcgccctgatgcgctttgacaaccagattaggtttggttatggatgaatctggcagcccgttaacgtcgcatacgctaccgtacttcgcgcgcagttcatcaatcggaccaaacttgatggcctccagcggacaggtcgcaacacagacgggcggttcacctttcgccagtaaatcaacgcacatgtcgcacttagacatttggccggtctgctcgttaagctgcggcgcgccataagggcaggaccaggcgcaatagccacagccgacgcatttgtcggtatcaacgcgcacaatgccgtcacccgggcgtttatgcatagcggtagtcgggcaatttttggtgcagacagggtccgcacagtggttgcaggaaatggaaagcgtataagcaaatacgttattgctgaccccaccctgcccggtcgggatgaaacttccgcccttgacttcatagacgcggcggaaacgacggcctacttccagattgtttttgtctttgcaggccacctggcaggctttacaaccggagcagcgtgaggagtcgatgaaaaatcccagttgtttatcgctcaccggcgggtaatgtgtaaactgactcatgctttagccacctccaccagcatggtttgatgtgaatttcccttcgccagcgcggtaatacgggccgagctgaggacgttcgcacagccgcctttatcaacgccgttttcatccggctgccaccaggcgccagcctgcatcgcgacaacgccgggaataatgcgcggcgtcacttccgccgggatttcgcaaatcccgcgtgagttatgaatgcgcaccatgtcgccatgcgtaatgccgcgcttttgcgcatcctgcgggttgatccacaatgtctgctgctgcacttcaatcagccacgggttagcgtattgcgttgagttggcgcggttttttcctttccacgtaattaactggagcggaaaatctttcgccagcgcatcctccgggccttcatgcgcgggaacgtagtgcgataacgccgggatttccggatgctgcatgtcgtagaggcgcttcgagaagatctctattttccctgacggcgtcgggaacggatgattttccggatcgcgaatattgtcttcaaaggcgataaatggcgcgcttttgaacagatgctgacgggtcttttgcagcgtggcgaaatccggcagattttcgtccggcatcgccaggcgcgtctgttcccagatgtgttcaatccacgctttctcatcgcgcccctggctaaattcattctcaatgcctaatttcgccgccacctcacgtagccagtcgtagtcggagcgccgctcaaattcaggctcaatcagtttttcagagagtatcaggtagcttgccgtgccccaggtttcaccgatgttccagcgttccataaagctggtttccggcagcagtagatcagcgtatttcgcgctcggcgtcataaacagatcgctggcgacaataaactggatctttgattcatcctccagtacgcgtaccgcctggtgcagatcggggttctgattcgccagatagttcccggccagcgagaacagaatacggatgttactgtccagcttatcggcatctttcagccccatatccggcgtcactttgctggcgtcgtctgcggcctgcacccagttcatcaccgaaattttggcttttaccgggttatccggcatctccggacccgcggcgaatttacggttagcgcagccgccgtaacccgcagcccaaccgcctttgatgccgacattaccggtaatggtcgccagtagagtcgaaccgcgcgcggtgcgctcgccgcagttgtggcgctgtggtccccacccctgaatcaacgcggcgggtttggtattcgcgtaatcacgcgctaactggcgaatggtttgcgccggcacatgggtgatcttttccgcccactcgggggacttaacgacaccgtctttggcgccggtcagatacgccaccagcgattcgttagccggtacgccttccggcattgagtcttcatcaaaaccgatagcgtaacgcgcaataaatgcgcgatcgtgcagattctcgctgatgatgacgtacatcatcgcgtccatcagcgcattgtcggtggtgggcagcagcgggatccactgatccgccagcgacgaaacggtgtcggaatagcgcggatcaaccacgataaaccgcgtaccgttctgcttcatcttctgcaagaaatagttggtatgaccaaaaatggtctccgtcgggttatggccccacagaatcaccagtttggtgtccaaaagcgtatccagtgaactgccgctggcggcaatgccgtaagtataaggcgtcgcggccgccgtgttgcccatactcacagaatggtagctttcgagatatccgccggtcagattcaacaggcgacgtgccattttatcgccggaaaaggtgccgccggaaacggcggtaccaacatgaacatagcgcgaagccgggccatatttttcagtaatcgattttaaattatcggcgattaaggttgtcgcttcatcccaggaaattcgctcaaattttccttcaccgcgttttcctacgcgcttcatgggatatttaagtctgtcaggatgataaacaaatttacggtatgcgcgtccacgaacacaggcacgcatcaccggcatttgcgcatccagcgcattatccggtcgcgttgaaattcgcgtcacgataccgtcactaacatgcgcccgaatatcgcatttgcccccgcagtcaaaagtgctgcatgtctgaacgactttttccgcaggcctgttttcagttgccgtcacagcgcgcgcctgagcggtagctggcgaggagacaaacggtaacgcaataagcgcggagctggcctggataaagtggcggcgagaaatagcgggctgttcgccatttccctggctttttatatttttcatgatccgactcgtcaaataaaaacccattctcacgtttttatgcgctggttctcttgatatttatcaagctccctcattaagggtaattccggaaaaattaataattctcattaactttaaattaaatgaaattcataatttattctgaagagttgttaacgtattaattcaaaattaaccgctgcaacctgaccggactcatccattacgacaagttgataacgtccagcgatattgagtaataaagaaaggcgattattttcgccattaacaggttcgccatttaaaaaccaccagcgacgccctttgccgccggtagtcgagacgggcagcgtgacgttttcctggcctggcaattgcctgatcaccgcgccatccctcactcctgacagcattaacggcgcggcgtcattgccctgtagcggcggacagtggtcggacgccgcgggcaagcgggcgctacgtctttccgcaggcggcagccacggctccagcggccgcggccagacgataaacgtatgcgcacgcgcctgcggacagtcggcagcgacacgccgccccgtatcatccagccagaccgggaaacgaataccgttgatgtcttcctgctcaggtaacagcagcgtgggcggctggctgtcatcgagcagccatgtcgccagtcggcggcgacagttgctgtctccggcaggcagagtctgtccgcccggccagcaaatgacgccgcggcttaccgcctgcggacgcggatcttccggcaggcgtcccgtatgcgccagtaacagattattgacctggttaagcaatggcaccgcgctggcaaaaccaaattgccccaccacaggcgtgccgtcgggtctgcctgtccagataccgatgatatagcgcgcgttaacgccaatagcccacgcatcgcgatagccgtaactggtgccggttttccacgccaacggcacaatgcgcggcagcgcgttatccggcaagggttgcgcttcatccgccataatccgtcgaatgatccacgccgctcccggcgacattaatggtctttccgacagcggatcgtccggctgtaaccgtagtttcgccgctttcccatgacgagcgaacgcgctgtatgccgccgccatctcgtcaagccgcgcgcccgcgccgcccagaatcagcgaaagattgggcgccgcgccagcaggcaaatatagcggcaggccgacgttacgcagttttgccgcaaatcgtttcggcccataggcttcaagcacctgaacggctggcagattcagcgagcgtaccagcgcgtcgctcatgctgaccgggccgtgaaatccgctgtcgaagtttcccgggcggtaatctccggtacggcgcggaacgtcctgtaataatgatgcgggatggatcaagccgtcatccagcgccagaccatacacaaagggtttgagtaccgatcccggcgatcggatcgccgttaccatgtcgacatgaccaaaacggctgtcgtcattaaggtctaccgatcctacccagccgcgcacgctcatatcggtatgatcgacgacgatcatcgccaacgaactgcgtgcaggcagccgccctttccatgcccgcgccagatcttccagttgccgctgcaacccggcgtccagcgtggtcacaattttgtcgttctggcttttactcaacatcattcgggcaaaaagcggcgccagttgcggcatttgacgcggcgccagccagaccggttcttcacgcgactcgcgtaccgtttcggcaggccagacgccctgcgccgccatccgatccagcactttatttcgtgccgcttcggctctcgcaggccagcggtcggggcgtaaccggctcggcgcctgcggcaatacggccagcagcgccgcgtcagcgtagctcaggcgcgcgggcggcttgccgaagtaggcccagcttgcagcgccaataccctgtagcgtgccgccgaacggcgcgcggttcaggtacagcgtcaggatatcgcgcttggacaaatgccattcaagctggagggcgcgccaaagctggcggattttaccgccgaacgtgcgcgaatgcgggtccagcagtctcgccacctgcatagtcagcgtactgccgccggaaataacgcgcccggcggtaagatcctgccatgccgcgcgcgcgacggagaaagggttaacgccagggtgccgccagaaccagcgatcttcgtaattgattagggcctccaggtagcggggagagacctcttcaatcgtcaccggataacgccagatccccccggcgtcggcaaagcgccacagcggcgtaccgtcatgggctaccacgacccgcgcaggatggacctcattgagcggcagcggccagagtttatccgctgcccataacgccaggaaaataaaaagcggcgcgcccgccagccacagccagcggccacgtttaccacgccaaccgttcatttaaggcgtcacaatcagcagcccctcgctcgcgccggttgcccgccactgaggcgcatacatcgattccacctgcggttgcgcaagctggtacgtccccggcgttaccgcgcgcgccaggtagaccagcgtcacgggctggccctcattgacaacgacggcagccacaaaccgatcgtcgcggaattccatatactgaatatccgcctgctgcatctgattaagcagattttgcacttcgctaccgctctccggcaggctggcgctgctgtcagccagattctggttttccagctccagcccggccgggagcaggtccaccaccagcgcatccggcacattgcgatcggccactaccgttaaccagaccagcaccagttcgccgctacgcaacgaggacagcgatttacgctgaccatcggtccccagtatttgtcgttcaatctgcaaaacgttgctggcaggctcaggcgcagatgagggatagccgctgctatccagacgcagccatagcggctggctaccggtgttcgtcacctcaagggcggccagctggtcagcatccagattacgggtcagcgccttgtcgcccgacagcggctgcgcctctaacgaggtctgcacctgccaggcgcccgcgctggcctgtcgcgaatgcgcggcgaggaacaaggcattgttctcctgggtagagagccagcgctgaccgaaggcctgctcagaaagcgagcttaatagcgcgttttgcgcgtccggtctgaggttgttctcttccagtagcgacaacatcagagcgttatcgcgcagagaactgccgtaatccgctatccattgccgttcgtcctgacgcggcgtattcagagccagcgtaatggcctcttcgccgcgtctggcatcacccatcgtgtttaacgcgatgcccaattgcatcagcggcagtcctgaagccgcctgactacggcgctcccagatttcgcgcagcgtgccgagcggcgctttctgctgacgcgccagtaccagcgcagcgtaagcctgagcggcaaaagtactggcctgagtattatcgctataacgaatcagcatcgtaccgggatcctgcagatagcgcagcagtcgctcattgccccggttaatggcctccggcgggacgctatatccctgctcgcccgcgcgaataaggaaatccatcgcgtaggccgttagccagggctcttccgccccattttcatcccatagcgcaaaaccgccgttatcacgctgcatctgtagtatccgggagatgccgatatctaccgcagcgcgccgtttttcatcgctatcgccggtaataccgagcgactgcaattgagcggcattggtatacagcgccgggaataacccactggtggtttgttccaggcacccgtacggatatgctttcagctcgcgaatgtagcgcgccagattgagcggcggttttccgcttaacagcagttgtccctgtaacgtggctggcgagatgtttgccagatgctgctctggtacatgccagctctctcccggagccagcgcaatgccgctatttaccgtttgggcaggccaggccggacgcacgccgatttgccactgcttatgctgcgcgtcgagggtttctcccggcagattcagaccgctaatggtcgcctggatttcgccttcgccaaaaccttccagcgcgcgtaccggaacgaataaggtggtgcgcacgcccggcgccaggttgaccggttgcggctgctggctaagcagttccagtaacccactggcggcgagcgcaatattcagcgtctgcggacggtcggtcagattggtgacgtccagcaccagtcgcgaaacatcccctcccgccagaaaacgcggcatattcagctcggcaatcactggcgcggcgacaacgactttgctttcgccgcgaccaaaatcgtccgctgtccatgcctgcgccataacccgcagttcgccgttaaagtcgccaatcggcagcgttacgaccccttcgccctgctcattgagcgtgatcggctgcgcctgctgcgcgatgatattgacatggtttaccggcggttttccgccgcgcttaaggtcgtcgccatcgccgccaaaacgcaacgccgccagccgcccctgcccttcaatgacctggccgtaaatatcgtagatatccgcaccgtagcgtttttgaccgaagaacgcctgccacgggtccggcgtcgcgtaatcggtgatgttcaatacgccgctatcgaccgcggagaccagcacgttgatctgttttggcatttcgccgtgtttaacgctggctttaaccctgacggtgagcggctgattcgggcgcattttagccgggctttccagcgccagatcgaggcggcggttgtcatcccccagcggtagatgtagtaaccccacggcgcgttttggcgtcgcggaacgagatttatcgccgggacgcaccaccagcgtactgagatagagatcgtggcgattccaggttttatccaccggaatcgtgagctccagcccctgcgccggcacgtcgatcgcctgccaccacagcggaccatcgctggactccaccatcgcataacctttaccggcgaccggcgcggcgatatgcaatttcatggtatcgcctggacgataattcgctttatccagtttgagggtgacgcgatccggacgcgccgcgccgctaccgtcgctgttatcctgccagctatagccggcccagaaacgaacgctgctgaccgtctcattcggcgctttgacctccagacggtacgcgccccattccaccgggaagctgacttttccggtttcatccgcgttcagatccagcgtctgctcgccctccaccagatctttttgatcaaactgcgactgccagccttcgctttccgaccagttccagtaatagtcgcgacgctcgcggatgagccgcacctgtaaaccggacaccgcttttttctcgccctgcgcgttggcgtaaacaatatcgaatgcggcgttgctgtcttcgtcgacaatcggttgattaacggtggtatccgtacggtagtcgtataccgctttggcggcgaactgtggacgaattcccggtaacgtatcggcaggccaaatcgcctgctctacgcgacgagtgaccggacgaccgccagactccagcaggctggcctgtagaattacctgcagcggcgaatgcgcttcttgccactggctggcagcactcacttcaccacgtccgcctttatccaacgtcagttgaacttcgtccaggctgcgcgaaagattctcttcggcaatattgccgaactggaagccaggcaacgccgcgacagcgtcgcgcaggggacgcaggaaaagttgcccttgcagggtattgccgttagcaggcgcgccatacaagtaatagccgacaacggagaatttcacctcatccgcaggcgccagcggtgttttttgcgccgtcaggttgagcgccatccgctccggcataaagtcttccacgtggaaatcccaactccgcagcaaattatcgccggtgttggcgcggacatgccacaagccggtcggcgcgttgatatccagcggataattcaaacggtatagcccgttttccggctggctgacgacggtacgcatcacctgtccgtctggttttaccacttccagcttaacgggttgatcgggcagcgttttaccgtcgctatcgcgcagtaatccgttgaggataaccgtttcgcccgggcggtagagatcgcgcgggccgaacataaagaactgcttgctgtagccgggcgcgccagcgacattaaattccgacagatccagagccggaagcgtgagatcgagcagcgtggtctgctcctctttacgcgccagtaatagcgccgccgctttatcagcctccagttgcacatgtccctgcgcgtcgctcgtcgcctgcgccagcgtctgccctttatcattcagaagaacgatctcaattcccgactgcgccgcgccgttttccaggctttgcgtaaagatatccagccgattatggtaacggtgcgcggacacgccgatatcgctaagggtaaacaacgtagcggcattactatagttgtagtgtccagcctgattcattaccgccacatatacgcccgcctgttgcagcggcttaatatcgcttaatggcagcagcagtttctcacgcgtattgcgcgccggattaagatcaaaacgaccggtataaaccagatccgccattttcagcagattgtcggactcccagttagagagagaactacggtactcccactggctgacaaatgacgccagcgatccgggcttaacgcggaaaaagttcacatcaacgtggttgacgttaagcgccatgaccggcagtccttccgcgattttccccggtagcagcgatccccggctggcaaagccgacgctgggctggacatcacgcgtggtaatcgttttttcataagacttgccgaaggtggcgttattcagcgccttaacggcgggatcaaccgtgaccaccagcacgcgctcaggttccagatgacgtaaccttagctcttttaaatttggcgccagctcccatgcgccgtcaacgctgccgcttttcttatcaaccacgtgaaccacacgggagaaatcctgttcaggatctaaaggaattgaaaacgtcagcaccagcgtcgccgcgccgtcgagctgcgcttcggaggcgtctaatagcgtgagcgctttgccctggctttgctgcgccagcttttgtagctgtgccgggtcttgcgcgggcgagggctgcgctacggctggcgcttcgcttttagtcgtcggggcggttttatcgttgttatcgcatcccgccagcgccagcatgatcatgcaggccaccacgcgtaaatgtttcatctttcatccctggccttaacggcctgtcagcaacggttgatgagatattatgcgcgagaaattttattgtgtaagtccgtattactgtgatgatgcgaaaattttacgcagaaatgtggtttcgccagccaaaacagcctcttctacttgtcccttttcgggaaacgtccgacaatttgaccataatcaggtaacaatggagatgcccatgaccaccgccttttttgtcgccgccgactggcttgccgaacatattgatgatccggaaatacagattcttgacgcccgtatggcgccgccaggacaggaacatcgtgatatggcgggcgaatatcgcgccggacatattcccggtgcgctgttttttgatattgaagcgctctccgatcgcgcatcgccgttgccgcatatgatgccgcgcccggaagcgtttgcggtagccatgcgtgaactgggtgttcgtcaggataaacacctggtcatatacgatgaaggcaatctgttctccgctccgcgggcatggtggatgctgcgcacgttcggtgccgagaaagtgtccattctggcgggcggactggcgggctggcagcgcgacgaatggctattgcgcgaaggcgaggaagcgcatgaaggaggcgagtttgaggcgaaattcgcgccgcaagccgtggtgcgtctcaccgacgtattgctggcaagtcatgaaaaaaccgcgcaaatcgttgacgcgcgtccggcggcgcgttttaacgctcaggctgatgaaccgcgtccgggactgaggcgcggacacattcctggcgcgctaaacgtcccgtggacggaactggtgtatgagggcgaattaaagaccactgacgaactgaatgaggtttttttcagccacggcgtgagtttcgacagaccgattatcgccagctgcggttccggcgtgacggccgcggtcgtggtgctggcgctcgccacgctggatgtgcctgacgtcacgctttacgacggcgcgtggagcgaatggggcgcgcgtaccgatttaccggttgaacccgcttaatatccgccatgccggatggcgctcacgcttatccggcctaccgttcaggctgatgtaaaacgatctacagacattgtttttattccgctcttttccgctgtcctgcaaacgggcattattttctcttaataaaatcctattttttatcggtaaatactttacgtccggtataaggagtatcattaccgctgtttttgttttcaccggaaaataactcctgtaaatataattttttaaggatggaaaatggatatttcactcactaatttaattgagttggttaaaaaggttaaccgtaataaggtacctactcctatgtctgccgaggaaataagtcgtctgcgagtgcgtaagtatcgcgatccgcaaaatacggaaaccactgagttacctgaaagcctgaaggcgctactggcctacgaccgcgatctcctgagcaattataatatgcctgtgattgaaacattacaaaaatctattgataacgagggagtaattcattcttactcccctgatgaagaggcgtattacggcgttggcatggatagctcaggtattgatattgaagatctgatgcctgtctggagtaacgatccccgtcttccggcattaattcgtatcgatcatgtcggcgatcaggccatttttatctatatcacagaacgggatgccaacggcgaataccctattgcccgcatggaacgtaatgaattctggctggcggagtcttccctggtggaatatctctataatattatttcgggcgctaaagacattggctttaccgaagaggatttacatcttccgcaatggaaggcacagcaaaaaatgaatgaacaacgcgatgccgctttacttgacctggaggattatcatgaggcgttttgggcaaaactggacgcgctcgtcgattaatcgacatgatgtcgggtggcgctcacgcttatccggcctaccgttcaggctgatttaaagcgaatctacataaattctgtttaagcaggccacaaaaaaaccgctcaattgagcggtttttttgtgctggtccggttcgcggcctttccagcaggctttgttgccatagcaacgcaggcacaccgtaggggattaatactcccttttaagggagcaaatgtcaatatgatttaccgggaaactattcaatatttgaggtattatctttcccggccctttccgccgtctcgcaaacgggcgctggcttcaggagaggataacccatggccgtaagcgcaggcacaccgtagtgcctgctatcacggcattatcgccagcggtgctgccgtgatgcggtcttcgcaaggaccgcaacatgaaggtacgatgcttttgtgtcgtgcttcttgtttctggcacgttgtgtcttcacgcagacagaagctacccaggtaattctgttcccgtaacgctcaacgtccagagcaggtaagccaggaggccgccctgttgggcggctttcttttcttcagatgatgcggttctgtttaaaatcgcgcaggaacccgccccagcggcgctcgtagaacggcgcgatatgctcggtgataaagtggctgataccctgctcgcccttcctcacctgacaaatatcgatcggttcgtcacccggtaacgtgtcggtcgccacattgcccgctgcgtgaatgatctcttcaatttcgccgtcagcctcaatgccaatcagcagattgggttgggcgtccgcatgttctttaatcgcgcagagaaacgcgcgtttcaccggtttgatggttttaaacagcgtagtgagggaatcaatcatctgcgacggcggctcggccacttcggatagaataagcgactcgccgccttccagcacttcctgcgtacttaacggactgccttcctcagcgagaagcaggctgatttcacgcggcataaactctttgccggtcggcaatttagcgttgaggaatagcgtttcgccaagcgtcatttcaaacagcgtgcgcgccggcatcaccacaaacgcctgttcgtcttccacggcctgctgcagcgcctccagagaagtaaagaagggaatgacggtcgtgccgtcttctttttcccagtgctgcaaatccagagcgctgtcttccacaatcgcctcgccttcggcagcgctgcccggcacccagacggtggactccagtaaggtacggaaaaatgccggacgatgcgcgggctcagtcgccgctttctccagcaagatttctaattcatttttagtttcggacataggaatcacaaattatgtatatgggttgtaggcctgataagacgcacggcgtcgccatcaggcaaaatgccgggtggcgcttcgcttacccggcctacaaaaacaccgttcaggcggtcagcaaattcgcgatggtgcgcacacccagaccggttgccccggcagcccactgctcaaccggcgctttgcgataagtggcggaacagtcaatgtgcagccagccttcgcggtaattttcaacaaagtgcgacaaaaaacccgcggcggtgcttgccccggcgggataagccgcgctgccggtgttgttcagttccgcaaagttagacggcagctggttacggtggaactccgccagcggcagacgccagaacggttcattttcttgcgccgcgctggtcaacaagcgccccgccagcgtatcgtcaaaactgaatagcgcatggtagtcgttacccagcgctgttttcgccgcgccggttaacgtcgccatatcaatgattagctgcgggtgttgcgcgctggcgtcaatcaggccatccgccagtaccagtcgcccctccgcatcggtattcatgacttcgacattcttaccattacggtagcgaataatatcgcccagtttaaacgcattgccgctgatcagattatcggcgcagcacaggaacagttttacgcgtttattcaacccacgggtaatggcgaacgccagcgcgcccgttactgtcgccgcgccgcccatatcggatttcattgagtccataaaagcgctttgtttgatactgtagccgccggagtcaaaggtgatacctttaccgaccaggcaggcataaaccggcgcatctttgtctcccgtcgggttgtaatccagcgccagcagcaccggcggacgctcagaaccacggcctacggtatgcaaccccatatagttctgctcgcgcagatcttcgcctttggtgatacggtaagtgacgctatcgcacgcgacgctgcacagcagatccactgcgcgctgcgccagttgctccggcccaagctcttccgccggagcattaatggtgtcgcgcacccagtcaataatggtcaggcggttatccagctcctgacgttgggcatcgtctaaatccggccacattacggtacggacgccttttggtcctttgtaacccgcccagaatgcccaacaacgctcggtatcccatccttcgcctgtcagcgcgacctgttttattcccaggccgtcgattttacgcgccgcacgctggatcaatcccagatcgtctttaccgttaagatgcaaggtaataccgtcgttattaatactgtaagtggctttatcgccccagcgcgcatcggcaggctgcgtggaaagcgtaattttcatggcttctgtcattgttattttccttattagcaaacgggccgccgtagggcagcccgttagatcttttgctaaatgattcgcgttgcaggaaggcggcaagtgagcgacaaattcgtcgggaacgaatttgcacagccaaaggctgcctctggtgagggacaaggatgtccctcatcatccccgggagcatagcaaactatgtgactggggtgagcgaacgtagccaacgcacctgcggcgaggatcatgacgcaaaaattactctgcttcatccaaccagactagcagaatcgcctccagaattttttcattggatgcgttagggtcgtcgtcaaaatcgtccagttcgcagatccactgatgcagatcggtgaaacgaacggttttaggatcgacatcaggatatgcgtcgtataacgcttcgccgatctcgcggctatcggtccacttgagtcccatactaccctctgttaatgctcacgcgcatggttgattgtgtaacgtggaatttcgataaccagatcgtcgtcggtaacgcgggcctggcagctcagtcgactttccggctccagcccccacgctttatccagcatatcgtcttcttcttccgaactttccggcaaggagtcgaagccttcacgtacaatacagtgacaggtggtgcaggcgcacgatttctcacaggcgtgttcaatctcgatgccgttgcgcagcgcaacgtcaagaatggtttcaccggtctcagcttccagaactgcgccatccggacaaagatcctgatgaggcagaataacaatcttcggcatgttaaacctcgtctacggaatggcctttcaacgcgcgacgaaccgactggtccatgcggcgagcggcaaattcctgggtttgtttatctacgtttttaatggcttgttctatggcgtcaacatcatcgccttgtgcgaccgcgcttaaatgtgcggcggcatcatcaatgcattgacgttctgcggcgcttaacagcgcggcgtcggcagttagcgcgccggtcaaactttccagcacgcgcgcggcttcgactttttgctccgccagcatacgcgctttcacgtcctgctcggcaaaactcatggaatccttgatcatcgaggcgatttcgccatcggtcaggccataggaaggtttgacctgaatggaggcctcgacgccggtggatttttccattgcggtgacgctcaacaggccatcggcgtctacctggaaggtcacgcgaatatgcgccccgcccgccggcagcggcggaatcccgcgcagcgcaaagcgcgccagcgagcggcagtcctgcaccagttcgcgttcgccctgcatcacatggatagacatcgcggtctggccgtctttgaaggtggtgaaatcctgcgcgcgcgccaccgggatagtggtgttgcgcggaatgactttttccaccaggccgcccatcgtttccagcccaagagagagtggaatcacgtccagcagcagcatttcgctgtccggcttgttgccgaccagaatatcggcctgaatcgctgcgccaatagcgaccactttatccgggtcaatagcggttaacggcgtgcggccaaaaaattcgcccacccgctcacgcaccagcggtacacgggtcgaaccgccgaccatgaccacttccagaacgtcctggggctcaacgccggcatctttcaatgcgcgacggcaggccaatagcgtgcgcttaaccagcgcggaaatgagatcgttaaactgctcgcgagtgatctccccctgccagcccgcaacgttaacgcgaacggtatcggcatcgcttaaggcgattttcgccgcaatcgcggcatccagcagttcgcgctgaacgcgattgtcgctacgatcggcaattcccgcctgctcacgaatatagtccgccagcagatggtcaaagtcgtcgccgccgagcgcagaatcaccgcccgtcgccagcacttcaaacaccccgcggctcaggcgtaaaatagagatatcgaaggtaccgccgccgagatcgtaaacagcaataacgccttctttgcctgagtccagaccgtaggcaatcgccgccgccgtcggttcgttgagcaggcgcagcacatgcaggcctgccagccgcgcggcgtctttcgttccctgacgttgggcatcatcgaaataggcgggaacggtaatcaccacgccatccagctcgccggagagcgattcgctagcccgcgcggccagcgctttgagaatatcagccgatacgcgcaccggattgagcaatccagccgccgtgtcaatcatcggcagcccattaacgcttgccttaaaccggtaaggcagatgcggatagcgcgtctggatatccgccagcgagcgtcccatcatgcgtttcacagagctgatagtgttggccgtatcctgcgcggcattgtcacgcgcagcgtaaccgaccgtatggccctgctgctgatagtgaaccactgaaggcaacaggtggcgcccttcgtggtcaggcagagtttccgcctggccgctgcgaaccgtcgcaaccagagagttggtagtgcctaagtcgatgcccgccgccagacgacgctgatgcggcgcggcgctcagaccaggctcactaatttgtaataaggccatgttagattccagttaaaaatcgagcagcttttcttcgagttgttctgcgctgcttcgcagtttatcgagaaaccgcagtttgcgcaccgtatccgccgccgcgtcccacgcggcgttgtccaactgttccaccatttgctgaagacgagcatcaaacatcttttgtacgcgtttgatgaagctttccagccgcgcgtcgtcttttgattgttcgatatcgtccagctcttcgcgaagcgtgagttgttccatcagaaacgcggtgtcgcgtaccgtatgttgctcgctggccagatcgaacccgtgtaaggaaagcagatactccgcgcgcgtcaaagggtgacgcagcgtttgccaggcctggttgatcgtggcggattgctggacggcggcaagctgctgcgcctgagtgccgttggcaaatttgtcagggtgatactggcgttgcagatcctgaaaacgaaggctcagcgcctgggtgtcaatctgataacgggctggtaagccaaagagggtgaagtaatccataacattctcagggatagcctgtcagaacaaaccccacacgcaggcgaccacggtggggttataccttcttacttcgcgccgcagatgcgttgtctgcgcgggttcccccagtcatttactcaagtaagcgccaggggattcactcgcttgccgcttttctacagcacgaatgctcggtataacagcggaacacggttacacgtggaagctttcgccgcaaccacactcatctttcacattcgggttggagaatttaaacccttcgttcagaccttcttttacgaagtccagctgtgtaccgtccagaaattgcaggctcttgccgtcaaccactaccttaacgcctttgtcttcaaacacggtgtcttccgccgttggctcgtcaacaaattccagtacataagccatacctgagcagccggaggttctcacgcccagacgcagaccaaaccctttaccacggttggccaggaaggtattaactcgcgctgctgcactgtcgctaagtgtaatcgacataacaaaacctcaatgttaacgttctattttatttcgcttcgcgtttgcttttgtaatccgcaatagcggctttaatcgcgtcttccgccagaatagagcagtgaattttcaccggcggcagttccagttcgtctgcaatgtcggtgtttttaatcgcctgcgcttcgtccagggatttccctttcacccactccgttaccagagaactggaggcgatagcggaaccgcagccgtaagtcttgaagcgcgcgtcttcaatgataccttcatcgttaactttaatctgcaacttcatgacgtcgccgcaggccggcgcgccaaccatgccgcttcccacgttatcgtcgttgttgtcaaacgaccctacgttacgcgggttctcatagtgatcgattactttttcgctgtaagccattataaattctcctgattccgataccgattaatgatgtgcccattcgatgctgttcagatccacaccctgcttgtacatttcccacagtggagaaaggtcacgcagacggccaatggatttacgaaccagatcaatggtgtagtcgatctcttcttcagtggtaaaacgacctaaagagaaacggatagagctatgcgccagttcgtcattcatgcccaacgcacgcagcacgtaggacggttccagactggcggaggtgcaggcggaaccggaagagaccgccaggtctttcagcgccatgatcagcgactcgccttcaacgtagttaaagctcacgttgagaatgtttggcgcgccctgctcaaggtcgccgttcaggtaaacttcttcaatatctttgatgccgttccacagacggttacgcagaccgcgcagacgggccatttcggtctccatctcttctttcgcgatacggtaagcttcgcccatgccgacaatctggtggacaggcagagtaccagagcgcataccgcgttcgtgcccgccgccatgcatctgcgcttcaatgcgaatacgcggcttacgacgcacatacagcgcgccaatgcctttcggaccataaattttatgaccggagaaggacatcagatccactttcagttggctcagatcgataggcagtttgcccacgctctgggtggcatcaacgtggtagatgataccgcgcgcgcggcacatttcgccgatggtcgcgatatcctgcaccacgccgatttcgttgttcacgtgcatgatggaaaccagaatggtgtcgtcacgcatcgctgcttcgagctcgttgagatcgatgatgccgttgcgctgcggcgccaggtaggtcacttcaaacccttcgcgctcaagctgacggcaggtgtccagcaccgctttgtgctcggtcttgctggtgatgatgtgcttgccttttttctgataaaagttggcagcgcctttaatcgccaggttatcagactccgtcgcccctgaggtaaagacgatttcacgcgggtcggcgccgaccagttcagcaatctggttgcgggcgatatcgacggcttcttcagcctgccagccgaaacggtgtgaacgagacgccgggttcccaaaggttccgtccagggtcagaaactgcatcattttctcggcaacacgcgggtccaccggcgtggttgcggagtagtcgagataaatcggtaatttcattgctcttaaactccgtacatcactcaatgcaaggaatcaggcaaccggctggatgtacgaccgtgttgacgggacgtccgcgtcccggcctgattctgaattcttttttacgcttcatccttcagacgaccgcggcgttcaccgcatgaggccgccagaagagatggcgtaatattttaattaagcgcgtaatttaacgtcgatagcgtcctgcgcacgaccgctggcgcgcggcgcgtcatgcgtgtgctggcgaccagacacatccagaacttcctggttattcaccagctcgcctaaggtaatattgttgagaaaaccggtcaggcgatcgcttaaatcacgccacagcgcatgggtcaggcatttatcgccgccctggcagccgcctttgccctggcaacgggtcgcgtcaacggattcatcaaccgcgctgatcacttcgccgaccgcgatactgccagcatctttacccagcagataaccgccgcccggcccgcgtacgctggaaaccagaccgtttttacgtaaacgggaaaatagctgttccagataagaaagggaaatcccctgacgttcagaaatatcagccaacggtaccgggcccgcttcggagttgagcgcaacgtctaacattgcggtcacggcataacgccctttagatgtcagtctcatgtcttacttaacctcaaactcgcccctgcccggggttttttattgtaaaatgggggtattgcatagcagggacaagtctgacattcccgagtaatttggtcaactatttacttgagtaaattagtcaggtatttagcgttccgtgcgatattgacgcggttacttgcctttattctgctgctcaatagacgccagaatcccacgcagaatattcaactcctggctttccgggcgggcgcgggtaaacagacggcgcaatttattcatcacctgccccggatggttttcgcgaataaagccagtggagagcaacgtttgctccagatggccgtagaagcgttcaagatcgtccaccagcggatacggcgtctcttcatgatctgccgcgtcgccgttttcctgcgtcgccagccaggccatgcggacttcatacgcgatgacctgtaccgccatcgccagattcaacgagctgtactccgggttagcggcaatagcgacgtgataatggcatttttgcaactcatcgttagtcagcccgacacgctcacgaccaaaaaccagcgcaaccggcgtatttgccgcttccgccacgctttttaagccgcactcgcgcggatcaagcatcggccacggcaaagtgcgggaacgggcgctggtgccgaccaccaggctacagccagccaacgcttcatccagcgtatcgacgatctgcgcattaccgatcacatcgctggcgcctgccgccagggcgatggcctgggagtccggtttcaccaacgggtttaccagccacaggttagttaagcccatggttttcatagcgcgagccacagagcccatattgccggtgtgggaggtttccaccagcacaattcgaatgttttgcagcattgtctttcttcagctaaagattattctgacatcttaccataaaaccaagacagattccgatctcgctgctatactctgcgccgttttcccgttctttaacatccagtgagagagaccgatgcatccgatgctgaccatcgccgtgcgcgcagcgcgcaaggcgggtaatgtaattgccaaaaactatgaaactccggacgctgtagaagcgagccaaaaaggcagtaacgattttgtgaccaatgtagataaggccgctgaagcggtgattatcgacaccattcgcaaatcttacccgcaacacactattatcaccgaagaaagcggtgagcacgttggcacagatcaggatgttcaatgggttatcgatccgctggatggcaccaccaacttcatcaaacgtctgccacacttcgctgtttccattgctgtacgcattaaaggccgtactgaagtggctgtcgtgtacgatccgatgcgtaacgaactgttcaccgccacccgcggtcagggcgcgcaactgaacggctaccgtctgcgcggcagtaccgctcgcgatctggacggcactatcctcgctactggcttcccgttcaaagccaaacaatacgcgaccacctacattaatattatcggcaagctgttcaccgaatgcgccgatttccgccgcaccggttccgccgcgctggatctggcctatgtggctgcaggtcgtgtcgatggtttctttgaaattggccttcgtccgtgggatttcgccgcgggcgaactgctggttcgtgaagcgggcggtatcgtcagcgatttcaccggcggtcataactacatgatgaccggtaatatcgtggcggggaatccgcgcgtcgttaaagccatgctggcgaatatgcgcgacgaactgagcgatgcgctgaagcgctaagtctcttcggcggatggggccactcatccgccgtgccttttcaggcgtttttcctaaacacagcctcatcgctttacttgcctgcatgtttttgtacgatcgctccctgctccgctattggcataaagcggcaaggaagcgaacatgacccttcaacatacccgacgcatcgtcaaatccctttttattctgtttatcattgtggtctgtatttatctgctaccccgcgtagcgatcaatgccttttattacccggacaataaagtctatgggccaacccctgccgaagctgaatccattacctttaccgccaaagatggcacgcatctgcacggctggtttattcccactgctttcggcaggccggaaaacgccgtcgcgacggtgattcatgtccatggcaacgccggaaatatgtcggcgcactggccgttagtcagttggctgccagaacgcaacgtaaacctgtttatgtttgattaccgtggttttggcgaatctgagggcaccccatcacaagaggggctactggacgatacgaaaagcgcgatagattatgtgcggcatcgcgccgacgttaaccccgagcgcctggtactgctggggcagagcctgggcggcaataatgtactggccgccgtaggccactgcgtaggctgcgcaaatatgcgctacgccgaccaggcgggcatacgtgcgattatccttgactcaacgtttttatcctattcctccatcgccaaccagatgatcccgggcagcggctatttgcttgatgaccgctatagcgcggatcgcaatattgccagcgtcagccccattccggtattgattcttcatggcacggcagaccatgttattccctggcaggacagtgagaaattgtatgccctcgcccgggagcccaaacaaaaaatcttcattcctgacggcgatcacattgatgctttttccggacgttatgcaaacctttaccgtgatgcaatgattaaatttattcagaccgcgctatccgctaaatagcgcgacgctgtatatatgcatattttatgattaagaatatatttattataccgatagtaaaaaccattttttcccgttagcgaaggcggtggattagcgctagcgtaacagtaatattcaactgatttttataacaatttattttcatttgtttttcctgaatattactgtggagtatgtgatggctatcaaaattacgcctgacgagtttagtttgcttatccagcgattaaacaaaaaatggcgcgtgtttgccccgtccgcagagtttcgcggcggacgtttttccgacactgacaacattatttatcaacggattagcggctggcgcgatctcatctggcacgagaaatcgcacatgtcgccgaataccattatcgcccctatcaccgaaacgctcttttatttcgataaagacaccattcaaattgccgagacagacacttccccgataatcatctttgcccgcgcctgcgacattaacgccatgtcgcggctggattatatgtatttatcaaatgggaataattccgattacagttatcaactgctacgggagcatattcgtttcgtccttattgagtgtgaagaaagcttcgaaaattgtttctgcgtctcaatgggtaccaataaaactgactgttatagcgccgccatgcgttttagcgatgagggcgcgcttgtcagcatccgcgatccctttatcgaggcggcgatacaagggctggggcaggaggctgactataccccctctttcgtcagcgaaaaccgggaaaccgtcgtcacgccggacagcgtttgccacgatccgcaaaaaattcgcgacattctcacccaccatccgctatgggacgcctacgacagccgctgcatcagttgtggccgctgcactaccgggtgcccaacctgtacctgctatagcgtctttgacgtcgcctatgatgaaaatccgcagcgcggcgaacgccgtcgccagtgggcaagctgcatggtgccgggctttagcgacatggccggcggtcatggttttcgcgaaaaacccggcgagcgtctgcgctaccgcgccctgcataaggtcaatgactacaaagcgcgcaacggcattgaacatatgtgcgtcggctgcggccgctgcgacgatcgctgcccgcaatacatcaaattttctttgattatcaacaaaatgaccgctgccgttcggcaggcgctggcagaggaggcataacgcatgtcacattgttcctgtcatgataaaccgcagcacagtttgctgcctgcggcgtaccgcatcctcagtattactcgccacacgccgctggagtggaatttccgcgtggccgtcgattttcccgcgcactgggggcaatttgttgaggtgtcgctgccgcgcgtcggcgaagcgcccatctccgtttccgactacggcgacggctggatagatctgctgattcgtaatgtcggaaaagtgaccagcgccctctttacgctgaaagaaggcgacaacgtgtggctacgcggctgctatggcaatggctatccggtcgatacgctgcgccataagcccttactggttgtcgcaggcggtacgggcgtcgcgccggtgaaaggcttaatgcgctatttcgttgagaatccccaggaaattggtcaactggatatgattctcggctataaaaatcgcgattgcgtgctgtacaaagaagaaatggcgacgtggcgcggcaaacataatctggtactcacgctggatgaaggcgaggctgatgaccgttaccagattggccgggtgaccgatcggcttgccgacatgacgcttagcgatatcgacactatgcaggccatcgtcgttgggccgccaataatgattacctttaccgtaaaaatgctgctgcaaaaagggctcaagccggagcaaatctgggtggactacgaacgccggatggcctgctccgtcgggaagtgcggccactgccgtatgggcgaagtgtatgtctgcaccgacggtccgatatttaactacgccgtcgcgcaacgttttgccgattaaggagaacatcatgagcattgatattgatatcattaaagcccgtgcgaaaaacgaatatcgcctgtcaaaagtgcgcggcgaagccatgatcagcgtccgcattcccggcggtattttgcccgcgcatttgctaacggtggcgcgtgacatcgccgaaacctggggcaacggacaaattcacctcactacccgccagaagctggcgatgccgggtatccgttacgaagatatcgacaacgtgaacgctgcgctggagccgtttcttcgcgagattgaaatagaactgtgcgacgtccaggttgaggataccaaagcgggctatctcgctattggcgggcgaaatattgtcgcctgtcaggggaaccgcatttgccagaaagccaacactgacacgaccggtctgtcccgtcgtcttgaaaaactggtctatcccagcccttatcatctcaaaacggtcatcgtcggctgcccgaatgattgcgcgaaggcgtcaatggccgatctggggattattggcgtggcgaaaatgcgcttcactgccgatcgctgtatcggttgcggcgcctgcgtgaaggcctgtagtcaccacgcggtaggctgcctggcgctgaagaacggcaaagcggtcaaagaagagtccgcctgtatcggctgcggcgagtgcgtgctggcctgtccgacgctggcctggcaacgtaagccggatcagctctggcaagtccgtctgggcggacgcaccagtaaaaagacgccgcgcgtcggcaagctcttcctcaactgggtgactgaagatgtgataaagcaggtgatcgttaacctgtatgaatttgaaaaagagatgctcggcggaaaaccgatctatctacatatgggccatctgatcgacaaaggcggctacctgcgttttaaagaacgggtactgcgcggcgttcagctcaatccggaagcgatggtcgccgaacgcatttactgggccgaagacgaatccgtcgcgcggatgcatctcaaacccgccgggcactaatcaaccacgccatggccgcagcccgcccacaggctgcggcacgctaaaccacatgaccagcgccgcgacaagcagtatgccccctccagccagcgccagcgttgaccagcctacctgccgccataacgccggcgctttgtttccactgagtttcaccgccagagcacgaaaagtgtgtaccagcaacgccagcgaggtaatcgttagcgaggttcccgccgccatcgccagtaccgacgccattccccagctaaaaacgccaatcactttactgaataacagcaccattatcgcgccggaacagggccgcatccccatagacagtacgatcatgaatcgcgcgcgccagtcatcgccgctatgcaattgttcctgcgtcggtagatgctgatgtccgcagccgcatttttcatggtgaacatggcgcggcgtaaaagcgataaagacaggtttacgtagcagcgcgcgtaacctttttatggcccgccagcacagcaaaatgcccagcccgccaactaacgcatagctccccttttccagccagaagccgctcagatggagctgcctggccggaagttgcaatacggtcagcacgcccaccaccaacccgatagccacgagcccctgtaataacgcggcggcgagggttaacacgatactcgatttcaacttcgaaggatgcgtcgccagccatgtcgcgatcaccactttgccgtgtcccggccccagcgcatgaagcacgccatacataaaactcagcagaagcaacgatccgcccgcccgctcaggatgcgtcgccaccgcgttaagcagcgcgctcaactgctgattcacgtcccgctgccaaagagcgcttttcaacatcacctgcggccaggcctgccacatccacagaccgccaaccagcatcagcagcaggaataacgccaatggccacagcgagagccagcgccgccccggagtgcgttgagaaaaaattactgacattgcaaggtcaccgtttgggcaaactgtttacctaaatccatatcctccggcggcgcgtcctctttatccagcgactgggcgaaacgtagcgtctcttcgccgggcgcaggagtataaacctgaatccgacacttttcgcgcagcggttccggcatcgtgatatcgctgtcctggtcataatgcatatcgacataataagagggatcaaacgttgaaaaggtataagtctgtccgcttaacggctgcggttcagccagcggtagcgtaaaggtcaataccgcctgatgcgcgtcacgcgtcataccgtattctgtcggcctgtttttaaacttcactttcgcgccattgcgccacacttctgtaaagtagtgctgcccaagtacgttagccatcacttccgccgccaactttttccatatttctgaccccggtgccgcgtttccggcgtcatacagcagatctgcggacgtcagcgcgtccattgtccagcgcatttttaacgccacaaattgctcattttcactgaccacctgcgtttgcagacggatgaagctgtgcggatgcgccgccgccacgaaagataaaacggcaagaaatagtgttaaggcgctgcgtttcactggcttcatctgttcctcgcgataaaaattctgtgacactcctcagcattcctggcctaaaagcacgcttatcacatttttcacacgcaaactttagctatccttaccagacaaactaacgggagacctgacagatgatgccgacaattgccccaccatctgtactttccgctccccagcgccgctgtcaggtattgctgacgcttttccagccggagccaattgccacggtggaaatcttcagcgcgcttaatggcgttgatgatgatactgcccgtgaggatatcactgagacaagcctggagatccagcgctatcatcgccttgccatcacaacatgccagaacggttgctatcggatcgaaggtacagcactcgatcagcgcctttgccttttacactggctcaggcgcggcctgcgtttatgcccgaccttcgtcacgcaacagtttaccccggccttaaaaaacgcgctaaagcagcgcggtatcgcgcgtccgctgtatgacgatattaatctgcacgcgctcatcaatctgtgcgcccgccggttgcaaaaaccatttgaacatcgcgacgtgcagttcctgcgtctctttttacagtattgtctgctacaacaccatgccggcatcaccccggaattcaaccctgtgcagcagatttgggcgcagtcgtgcgcggaatatccactcgcccaggaaattggtcgtcactggcagcgccacgtgatgcaggccgcaccgctcaatgaagcgctgtttatggcgttactgttttcaatgattcgcctccccgacccgattcgcgacacgcatcaacgggcgcagcaactgcgactggaggtggcgcggctggtgctgcgctttcgagaaaaagggaacgtacgcttcagcgacgaacaagggcttaacgatcagctgtatgtccatctcgcccaggcgctgaaccgaagtttattcacgattggcatcgataatacgcttccggaagagtttaaccgtctttatccgcgtctggttcgcaccacacgtgaggcgctcgccggatttgaagccgaatatggtatccacttttccgaggaagagacggggctggtggcagtgattttcggcgcctggctaatgcaggataacgatttgcatgagagacagatcgtattgttagcggataaaaatgatgcgctggagacgcatattgagcagcaactgcgtgaactgaccctgttgccgctgaatatcagacggatatcgctccaggcgtttcaaaaagagggatgcccgcgcggcgtagcgctgattgttaccccttacgccacgccgctaccgctcttctcaccgccgttaattcatgcggatcgcgccctcacagagcaccaacagcagcagatccgcaagatcctggaatcatgacgcggcaaccactttgggccgaaggaagatagcgggcaatgccaccagcgccataatccagaatacgccgccgcccagatgttgatacagaaaaccggcaaataccgtcataatcgcgatactgccgcccatcgccacagcggaatagacggcctgcaaacgaatcacctcgcttccctgacgcgcagcgatatagcgcatggcggccagatggcaaacggtaaacgtgccacagtgcaggatttgtatcacaatcagccacggcaacgccgtactccagcccatcagtccccagcgtaccacgccgcacacagcggaaagcaacagcaagtcgcgggcgctaaaccggcggaatagctttttactcagggcgaaaatgatcacttccgccaccacgcccaacgaccataaatagccgaccgccgatgctgaatagccagccccctgccagtagatggcgctaaaaccgtagtaggcggcgtgcgccccttgcagcaaacagacgcaggcgagaaaacgccaactttgtgccaccagcgtacgccaggcgggccagcctgcgctctcctgctgacggctttccccttgcggcggcacgctgggacgtaacaacatacccagcaacatcgaggcgacgccgagcgtcagtagcgccagaatcgcctggtaatcgtataaactcaccagcttaccggtcagcgccgaccctatcacgaaggcgatggacccccacagccgcacccgaccatagtccagggtaatttgcttttgccaggtattggccagcgcatcggtcagcggcaccagtggcgaaaagaagaggttaaacccaaccatcaccaccattagccacgcgacatgcgttcctgcccaaaatgccagcgcaaataccagcgtcagcaatgccaggacgcgcagcgcggagatcaaccgcgaaggatcgcttacgcgaggcgcaatgagcagactaccgagaaaacgcgcgaccagacccacgcccagcagaagaccgatggtttccggcgttagcccaagacctttgagccagacgctccagaagggcagaaaaataccgtaactaaagaagtaggtgaaataactgagcgccagccagcgcgtggaatgcaatgccatgattccctcccgtttggaggcgatagtctggcggtaaacggttgcgctggcaagggtaacataaggttaacaggcggagggagaagttcaaacggcaacgccgccggataatgacttccggcggcgtcacgttatggcgcataagtaatgcccgacagacgcagcgccatcgggccattttcacaacacaagcgcttatgcgtaaaccgggaagcgtgcgcagatatccagcactttcgctttcacgcgttcaatggtggcttcatcattgatgttgtccagcacgtcacacatccagccagccagctctttcacttccgcttctttgaagccgcgacgagtaaccgccggagaaccaatacggataccggaggtcacgaacgggctcttaggatcgttcggcacgctgtttttgttcacggtgatgttagcacggcccagcgcggcgtcagcttctttaccggtcaggtttttatccaccaggtccagcaggaacaggtggttctcagtgccgccagacaccactttgtagccgcggttcaggaacacttccaccatcgctttggcgtttttcgccacctgctgctggtaaactttgaactccggctccatcgcttctttcagcgctaccgctttaccggcgatcacgtgcatcagcgggccgccctgcgcgcttgggaagacggcggagttcagttttttatacagctcttcatcgccgcccttcgccaggatcaggccgccgcgcggacccgccagggttttgtgggtggtggtggtgacaacgtgagcgtgcggaaccgggttcgggtaaacgcctgcggcaatcaggcccgccacgtgcgccatgtcgacaaacaggtatgcgccgatgctgtcagcgatttcacgcatttttgcccagtcaaccacgccggagtaggcagagaagccaccgataatcatcttcggcttgtgctctttggccagcttcgccatctcgtcatagtcaattttaccggactcatcgataccgtaaggtacgatgttgtacagtttaccggagaagttaaccggggagccgtgagtcaggtggccgccctgcgccaggttcatacccagaacggtatcgcccggctgcagcagcgcggtgtaaacagcgaagttagcctgagaaccggagtgcggctgcacgttagcgtagtcggcgccgaacagttctttcgcgcggtcgatagccagttgctctacgacatcaacgtattcgcaaccgccgtagtagcgcttgcccggataaccttcagcgtatttgttggtcagctgagacccctgcgcctgcatcacgcgcgggctggtgtagttttcggaggcgatcagttcgatgtgctcttcctgacgtactttttcctgctccatagcctgccacaattcggcatcataatcggcaatgttcatttcacgctttaacatccgcatctcctgactcagctaacaataaaatttgtgcctgaaaaggcagtccgtgggacttcggccaacagtataaccgaatcattcttcgataacaggtcttgacaaaggtttttacgcaaacgattacctatgcgtcagataagggtttcctgaacgagagtctgacgaatttcaacggatttcttttcagctttgtgatgcagatttttcacgttgttacctccataacgtaaagcagagaagatccatttacaatgcaagggtatttttataagatgcatttgatatacatcattagattttcacataaaggaagcacgtatgcttgacgcacaaaccatcgctacagtaaaggccaccattcccctgctggttgaaacaggaccgaaactgaccgcccacttctacgaccgtatgtttacgcataacccggagctcaaagaaatcttcaatatgagcaaccagcgtaacggcgatcagcgtgaagccctgtttaatgctatcgcggcctacgccagcaatatcgaaaatttaccggcgttgctgccggcggtagaaaaaatcgcgcagaagcacaccagcttccagattaagccggagcagtacaacatcgtcgggacacatctgctggcgacgctggacgaaatgttcaacccgggccaggaagtgctggacgcgtggggcaaagcctatggcgtactggctaacgtctttattcatcgggaagccgagatttatcacgagaacgccagcaaagacggcggctgggaaggcacgcgccccttccgcatcgttgcgaaaaccccgcgtagcgcactgatcaccagctttgagtttgaaccagtcgacggcggtacggtggcggaataccgtcccgggcagtatctgggcgtctggctgaagccggaaggttttgcgcatcaggagatccgccaatattcactgacccgtaaacccgatggcaaagggtaccgtattgccgtgaagcgtgaagacggcggccaggtatcaaactggttacaccatcacgccagcgtaggcgatggggtgcatctggctgcgccggcaggtgacttctttatgaatgtcgccgctgatacccccgtttcgctgatttccgctggcgtcggccagacgccgatgttagcgatgctcgatacgctggcgaaagaacagcataccgcgcaggtgaactggttccacgcggcggagaacggcgacgtccatgcgtttgccgacgaagtgagcgagctgggccgtacactgccgcgtttcactgcccatacctggtaccgcgagccgactgagtccgatcgcgcccaacgcctcttcgacagcgaagggctgatggatttaagcaaactggaagccgcgatcagcgatccagcaatgcagttctatctttgcggcccggtaggctttatgcagtttgccgcaaaacaactggtttcacttggcgtgaataacgaaaacattcattacgaatgcttcggcccgcataaagtgctgtaattgcaacaaatcctctgaaaaaacgggcgttatcgttaaggcgaacgcccgttttcctccccgttcccctgcttattgcgctgctttttatgcctttcttttacaaaaaaggggaataaaaaaagtctgtgcaaatcgtgttattattaacgtttgacttagctcgttagggcatctttttatgcagcaacctgttgtacgcattggagagtggctggttacaccttctgttaatcagatcagtcgtcagggacgccagattactcttgaaccacggctgatcgatcttctgatgtattttgcgcatcacccggatgaagtgttaagccgggataacattattgatcatgtctggatgcgcaccatcgtgaccaaccatgttgtcacccaaagcatttctgaactacgcaaatcattaagagatggcggagacagcaatgctgaatacatcgttaccgtacctaaacgcggctataagctgacggcgccggttatctggtgcgaagaaaatagcgatgagatcgataattcatcaacgtcgccgccgccgccgatcgcagcgacgaatgcagaaccgacggagggggttactgccgctacgcctgtgccgcccgcctctttgcaaacgccgactaaaaaggcgaaaaagccgcgtattgccgctttctggacgtgggtgatgttcctgctctcgctggcgacgctggtggtgtttatcgtgatgtcggtggtagatcataatgccgcggtaacaaaaacgcggttattacttaacccacgagatatagatgttcgttttgaaggcggcaattcctgtaataactgggtctcgcaggagtcctacgccatcggtctgggcggcttaatcaccgacctgctgaacacctactcgacttttatggtgcacgataaaaccaattaccgggtcaatgagccaagcagctccggtaagacgttaaccattcagtttgtcaatcagcgccactatcgggcgcagcagtgctttatgtctgtagtgctcattgataacgccgatggttcaaccatgctggataagcgttatttcgtcaccaatactaaccagttgtccatccaggatgatctgtttaatagcctgtctttcgttttaacacagccctggcctaatcgtatgcgagaacaactggccctgttcagaacgccgcaaaataccgcactgatgcgtttttatgaggcgcgccagcttattctgagcggcgatgcgcaggcgctaggtaaagccagcgatattctgaatggcattattaaggaaacgcctgatttcaactatgcctatgaatataaagtgctggtagatgtattacggcaatcacagcagccgtttgataaagaacaagtggccgcactgaacgaagagtttaaaaaaatagatcaaattccgggcgttgagaaaacgtctgtttattataaaatcaagaccgtcgatctgttaggcaaaggtgatatcgatgcagcgtatgaggaaatcaataaaagcatcgagcttgaaatgtcgtggtttaactatgtcctgttggggaaagtttacgaaatgaaaggtgagaatcgtctggccgctgatgcctatctgaccgcctttaatttacgtccaggtgaaaacactctgtactggatcgagaacggcgtatttcagacatccgttcagaaaattgtcccttatctgaatagttttctggcagaagattaaatttaacgctgaaccatgacaaataaaagcgaaaagatattaaatttttcgcttttattttgtgaaaaacatgttgccaaaaatagcttatgttaattttggcaacatattcattgcaaagatatgtaaatataactctttgtaattaaacgatgtttatcctttaatgatattttccatgatatttatatgttaattcaaaaaaatcaatctatcagttttttcatgtttgtgtttatttcactttttctttaggacttatctcaacccattcgttaatcttgtcgacagttgaacgggcacgcagcatatatgaagcataagcccggttcttaaaaatacagctcaggagaaatgaacatgagttctgtcaaaaagatcgggctatttgcctgtactggcgtcgttgccggtaatatgatggggagcgggattgcattattacccgccaaccttgccagtattggtggcattgccatctggggctgggtaatttctattattggggcaatgtcgctggcttatgtttatgcgaggctggcaaccaaaaaccctcaacagggtggccctatcgcttatgctggggaaatatctccggcgtttggtttccagaccggcgttctttattatcacgcaaactggattggtaacttagccatcggtattaccgcggtttcttatctttctacgttcttcccggcattaaataatccaataccggcaggtattgcctgtattgctatcgtctggctgttcacctttattaatatgctgggtggggcctgggtcagccgcttgacaacgattggcctattcctggtgctgatcccggtagtcttgaccgcagtcgccggctggcattggttcgatatcgcgacctatcacgcgaactggaacacgtccacgacgaccgactctcacgccattgttaaaagtattctgctctgcctgtgggcgttcgttggcgttgagtctgccgccgtcagcaccggcatggtgaaaaacccgaaacgcaccgtaccgctggcaaccatgctgggtaccgcgctggcaggcatcatctatatcgctgcgactcaggttatcgccgggatgttcccagcttccgttatggcctcttccggcgcgccgttcgctatcagtacctccacgattctgggtggctgggctgcgccgctggtttccgcctttaccgctttcgcctgcctgacgtctctgggctcctggatgatgctggtcggccaggctggggttcgcgccgccaacgacggcaacttcccgaaaatttacggtgaaatggataaaaacggtattccgaaaaaaggtctgctgttggctgcggtgaaaatgacggcgctgatgattctgatcaccatcatgaactccagcggcggtaaagcgtccgacctgttcggcgaactgaccgggattgccgtactgcttaccatgctgccgtacttctactcctgtgttgacctgattcgcttcgaagggttcaacatccgtaactcggtaagcctgatttgttctgtactgggctgcgcattttgcttcatcgcactgatgggcgccagctccttcgaactctccggcacctttatcgtcagtctgatcatcctgatgttctacggtcgcaaaatgcaccagcgccagaacaacgacagcgacaacaatacggctgaagcgctttaaccgctaactcctttttctcaaagcccctttcgtcacctgctatagcgtagcgggaggggcccactttaccaggaacaagactatgaacgttattgctatcatgaaccacatgggcgtctactttaaagaagagcctattcgtgaactgcatcgtgcactggaaggtttaaatttccgtatcgtctatccaaacgaccgagaagacctgctgaagctgattgaaaataactcccgcctttgcggcgtcattttcgactgggataaatataaccttgagctttgcgaagagattagcaagctgaacgagtatatgccgctgtacgccttcgccaacagctactctacgctggacgtcagcctcaacgatctgagaatgcaggttcgcttctttgaatatgctttaggcgccgcagccgatatcgcggcgaaaattcgccagaataccgatgaatacatcgacaatattctgccgccgctgacaaaagcgctgttcaaatatgtgcgcgaagggaaatatactttctgtacgcctggccacatgggcgggaccgctttccagaaaagccccgtcggcagcatcttttatgatttcttcggcccgaacacgatgaaatccgatatttcgatttccgtttctgaactgggttcgctgctggaccactccggcccgcataaagaagcggaagagtatatcgcccgcgtctttaacgccgaacgtagctacatggtgacgaacggcacctctacggcgaacaaaatcgtcggtatgtactccgcgccggcaggcagcacggtactgattgaccgtaactgccataaatcgctgacccatctgatgatgatgagcgacattacgccgatttatttccgcccaacccgtaacgcctacggtattcttggcggtattccgcaaagcgagttccagcacgccactatcgctaaacgggtaaaagagacgcctaacgcaacctggccggtccatgctgttattactaactcaacctatgacggtctgttgtataacactgactacatcaagaaaactctggatgtgaagtccattcattttgactccgcctgggtgccttataccaatttctcccctatttatcagggtaaatgcggtatgagcggcgaccgtgtggaaggcaaaatcatttatgaaacccagtccacgcataaactgctggcggcgttttcacaggcatccatgattcatgttaaaggcgacattaacgaagaaacctttaacgaagcctacatgatgcataccaccacttctccgcactacggtatcgtagcgtctactgaaaccgcagcggcgatgatgaaaggtaatgcgggtaaacgcctgattaacggctctattgaacgtgcgattaaattccgtaaagaaattaaacgcctgaaaagcgaatctgacggctggttctttgacgtatggcagccggaacatatcgatggagctgagtgctggccgctgcgttcagatagcgcatggcatggcttcaaaaatatcgataacgaacacatgtacctcgacccgatcaaagtcactatcctgacgccggggatgaagaaagacggtacgatggatgagttcggtattccggcaagtctggtcgccaaatatctcgatgaacgcggcatcatcgtagaaaaaaccggtccatacaacctgctgttcctgttcagcattggtatcgacaaaaccaaagctctgagcctgctgcgcgcgctcactgaatttaaacgcgcctttgacctgaacctgcgcgtcaaaaacattctgccggcactgtaccgcgaagcgcctgagttttatgaaaatatgcgcatccaggaactggcgcagaatattcataaactggtcgaacatcataatctgccggacttaatgtaccgtgcgtttgaagtgctgccgaaaatggtgatgacgccgtatactgcgttccagaaagagctgcatggcgaaacggaagaggtgtatcttgaagagatggttggacgcgtcaacgccaacatgatccttccttaccctccgggagtgccgctggtgatgcctggtgaaatgatcaccgaggaaagccgtccggtactggaattcctgcaaatgctgtgcgaaatcggcgcccactatccgggcttcgaaaccgatatccacggcgcctatcgtcaggcagacggacgttacaccgttaaggtgctgaaagaaaatacgaaataagtaccaaagggaagtggcttgccacttcccttttttcacgcagcaaggagactttatgaaaacaccctcacaaccgcgcgcgattttttacatcgtggcgattcaaatttgggaatacttcagcttttacggcatgcgtgccttactcatcctttatcttacccaccagcttggttttaatgacagccacgcgatcaacctcttcagcgcctacgcctctttagtttacgttacccctattcttggcggctggcttgccgaccgcctgcttggcaaccgcgtggcggttatcaccggcgccctgttgatgacgctgggtcatgtggtattgggcttagaatctgattcaacgttgagtttatatgcggcgctggccattattatctgcggctacggcttgtttaaatccaatattagctgtctgctgggcgaactttacgcccctgatgacaaccgccgcgacgggggattctcgctgctctacgccgccgggaatattggatcgatagccgcgccgatcgcctgtggtctggcggcgcagtggtatggctggcatgtcggctttgcgctggcgggcgtgggaatgttcatcggcctgctcatctttttaagcggtcatcgccactttcagcagacgcgcggtgttaatcgccccgcgctgcgggcggttaaattcgcccttccaacctggggttggctggtattaatgctgtgtatcgcaccggtattcttcaccctcctgctggaaaataactggtctggctatgtgctggccattgtctgcgtcttcgcggcgcaacttatcgcccgtattatggttaaatttcccgaacaccgtcgcgccttgtggcaaatcgttctgttaatgatcaccggcactctcttctgggttctggcgcagcagggcggaagttcgatcagtttattcatcgaccgttttgtcaaccgccactggctaaacatgaccgtccccaccgcattgttccagtcggtcaatgcgattgcggtgatggcggcgggcgtggtgctggcgtggctgagcagcccgaaagagagcgcccgctcggtgctgcgcgtctggcttaaatttgccgtggggctggtattgatgggcggcggttttatgctgctggcgctaaacgcgcatcaggcccggttagacgggcaggcatcaatgggaatgatgatcgcagggctggcgctgatgggctttgcggaactgtttattgatccggtcgcgatggcgcaaattacccgcctcaacctgcctggcgtcacgggcgtactgaccggtatttatatgctggcgaccggcgcggtcgctaactggctggctggcgtggtcgcgcaacaaaccacggaatcgcaaattagtgatacggcggtagccgcctacggacactttttctcgcaaatgggcgagtggacgctaagttgcgtggcgctgatcgtcgccattgtcggcctgagatgggtttgcacccggactacatcggcgctaccgcagggcgattaaacggtggttcgctgcccacaaggaggagacgggcagcgaatcggcacatcagatagccgcgtcgtcttcttcgccagtacggatacgaataacgcgggcgacatcaaagacaaagatcttaccgtcgccgattttccccgtctgcgcggtacgaatgatggtatcaacacaggtatccacgatgtcgtcaggcacaacgatttcaatttttaccttcggcagaaaatccaccatatattccgcgccgcgatacagctcggtgtggcctttttgacggccaaaacctttgacttcagtgaccgtcatgccggtaatacctacctcggccagcgcttcacggacatcgtccagcttgaagggtttaataatcgcatcaatctttttcatgctattccttgaaaaggtcgcctgtgttttgatcggttaaacgtaacatatttcgcgctactttacggcatgaaaactactctttgaaatcattcgcatccagttcgtgacgggagagtagcttatagaattccgtgcggttgcgccccgccatccttgccgcgtgcgtcacgttacctttggtaatttgcagtaacttgcgcagatagttcagttcaaattggtttcgcgcttcggcaaaagttggcagcgcggtgttttcgccttccagcgcctgctcgaccaacgcatcgctgatcaccggcgaagaagttaacgccacgcattgttcaatgacgttgaccagttggcgcacgttgcccggccagcttgccgtcatcagccgtttcattgcatcagtagaaaaggcgcgaacaaacggtttatgccgctgtgccgactgtctgagcagatgattagccagcagcggaatatcctcggtacgctccgccagcgccggaattttcaggctcacgacattcagccggtagtacaaatcttcacgaaattcgccccgcgccatcgccttcggcagatcgcggtgcgtcgcggaaataattcgcacgtcgatatcaatatcgcgattgctgcccagcggcctgactttgcgctcctgtaacacccgcagcagcttcacctgtaacggcgcgggcatatcgccaatttcatccagaaacagcgtgccgccttccgccgcctggaacaacccttcacgattgctcactgcgccggtaaaggcgccgcgcgcatggccgaataattcggactccagcaactgttccggtaacgcgccgcagttaatggcgacaaacggcttgttactgcgcgggctggcattatgaatcgcctgtgcgaaaatctctttcccggtgccgctttgtccgttaatcaatacgctgacatccgactgcgcgaccatgcgcgcctgttcaagcagtcgcagcatcagcgggctacgggtaacgatagcgttgcgccagctatcgtccgtcgcgggagcggactgctccagcgcttcatctatcgctttatataacgcgtctctgtcgatcggcttcgtcaaaaagctgaatacgcctttctgggtagcggccaccgcatccggaatagaaccatgcgccgtcagaatgataaccggcattcccggctgtactttctgaatttctgtgaacagttgcataccatccatttcgtccatgcgcaggtcgcttattaccagatccactttttcccgatgtagtacccgtagtccttcctggccgctctctgcggtcacgacgctgtatccttcactggtcaggcgcataccgagcaatttcagtaatccgggatcgtcatcgaccagcagcaggtgcgccggtttacggcttatcatggcgttacctcatcttgtgacggcgacggcgccgcgccatcttcagacgtcgcgggtttgtcattcgtatgcggcgtatcggcgttgtaattccctgccggttttcgtgtcgaaagctggcgctcaatatcggttaaactctccagcttacgggtggtaagatcgagctgcgtttgcaaggcctgttgctgctggcgcagcgcatccagctcactatctgacatttgctggagtttgctataacgctgacgttcggcagaaagcgccagttgcagcgcctgaccgtcatgccagatttggtagacgggccgtacctgagccggtatttgcgcgcttaacgcctccagacgggtcactatggcgcgccgctccggcggcgtaatttttgcatccgccagtaaaatcccgcgcctgaaggcattttgccagttatcatccgtcaacgcgcgcgcctctgcgcgcgactgaaccggcatcagacgatcggcgcagtcaatcgtgcgtagccagtacagcggattcgtctccaccgcctgcccgcgtagcgaccagatatccgcgcacgccgtcgggagataatccgccagttgataatgggggagcgtgtcctgcgctgcgctaccgggcagttgctgtgaagcatggggaacacatgcggtcagcgccagacacgatatgcccaccggtattccccaccgcaaaaggcatcgtttaatagtttggacgaaaacgtgtgacatacgcaccaggcttaaattcatattagtgtttgtcagatgcaggcaatggcagcgagatgcgaaaacaaacttcctgcgcgttgtcatccaccagttggatctctccctgcattcgacgaatacaatctctggcgatactcagccctaacccactgccttttaccgccccttttcgctggtggcttccctggaaaaaaggctcaaaaatcatttctctttcggtttgcggaatcggctcgccgctattaaccacatcgatataaaccgtggagccctgagagcgactacggatacaaatgttaccggattcagcgccatagtgcaccgcgttggaatagagattatccagcacgctcatcagcaacatgggctctgctatgcagcgttcggcctccaggtcgacatcggtatgcatcattttagcgcgggcaggcaaactgtgggcggaaaccaccatatccacaagcggcgcgatatcgaccgcttccagctctgtggcactgtctaccagtttccggttgtaatcaagcaattgctcaatcaatttttgtaaattacgactgctgtcatccagaatatcgaccacctctttttgctccggcgtcagcggcccaaccacctgatcggccagcagctcagtcccctcgcgcatactggccagcggggttttcagctcatgggacaggtgacgtagaaactgatggcgctgggattccagccacgccagacgctcactcagccagataatgcgctgccccaccgatcgtaattcacgcggaccggtaaaggtgacggtattccccaaagaacggccttcgcccaggcgattaatcatccgttcaattcctttcaccggcccgataatcatgcgggtaaaaagtagcaccatcgccaggctcaccagaaatagcaccagcgcctgccagccgaaaaattgtccgcgctcggcgatttcttgttgtaactgctgcccgcgcgagtaaaccacggtacgcgtcgcctgcaccatttccgtattcgcgttggcaaaggcctccaggcgcgcggccgctgccgcttccgggccgctatctttacactgcaattgcgccagcgcgtttaaatcctggcgtaacgcctgatacaacttatcatccggcaagacgccggcatgggcgtccagcatatcgctatagcgcttacgctggctttgatacacttttgccagcgtcggatcgtcaagcacgcaatactgtcggtagcttcgctccatctccagcgcgacgttggtcatcgcctcgctgcgccgggcgtcaataagcgtgctgcggttagtcaccgcagcctgatcgcttaacgcgttaaggctttgccacgcctgccaggccagaaccagcaacggcagcaggatcagcaaaaaggccagcatgaccaattgtcgtaaagaacgggggaaaacagaccagcgcttcaacgtgtcgctcacataaaagaagaataaaaaagatgctaaccgagggaagcgccagatacaacaaagccgggctaaacccggctttgttatggaataaggcggtgcctaactcgacgtttcgcccggaggttgataaagctacgctgttatcagaagttggacggcaggcaccttgttgtgcgtcattcgaagtttatgtagcgcgtccctaaggggctgacataagaaggtgaatgagccactggttaccattatgcagtaattgtgccaacattcaaaagaatttgttaacataatgatagatatgaaaaatatcgttattcatgctaaaaatggctctgtctgttttttgccctttctgtcgccaatcagcaacacctgcaacacctaaaaataaaacaatttaaaatcaaatagttaaatgtctctttttggcgacaacctatcccccactcatgtcgggatttcccgacactttaatcttgcggcataagcgctagtttattgccggatggcggcgtaaacgccttatccggcctaccgcttgacgttcaagacggtagctacaaccgcgcttccccgtgggcctgataagcgccgtctacaaaaaagcccctcgtgaagaggggcttaatggctatcgggctaattaaccaagctgcttacgcgcattacggaagatacgcatccacgggctatcctcgccccagttttccgggtgccaggagttggcgacggtgcggaatacgcgttccggatgcggcatcataatcgtcacccgaccgttttcggtcgtcaccgccgtgatgccgttcggcgaaccgttcgggttagccggataggtttcggtcaccttaccaaagttatcaacgtagcgcagagcgaccaggcctttgctctcaagcgcggcaagatgcgcatcgtcacgcacctcaacgcgcccttccccatgggaaaccgcaatcggcatctgtgagcctaccattccttgcagcagcagcgatgggctttgcgtcacttctaccaggctgaagcgggcttcgaagcggtcagaatggttacgtacaaaacgcggccacagttcgctgcccgggatcagctcgcgcagattcgacatcatctggcaaccgttgcacacgcccagcgccagcgtctgcggacgatggaagaaggtttcgaattcgtcgcgcacccgatggttaaacagaatggatttcgcccagccttcgcccgcccccagcacgtcgccgtaggaaaagccgccgcaagccaccagcgcatggaagttacccagaccgatacgaccgcccagcaggtcgctcatatggacgtcaatcgcgtcaaagcccgcacgatggaacgccgccgccatctccacgtgagagttcaccccctgctcgcgcagtacagcgactttcggtcgtgcgcctgtcgcaatgtacggcgcggcgatatcttcattaatatcaaacgacagcttcacgttgaggcccggatcggtatcattcgctttcgcctcgtgttcctggtcggcacattgcggattgtcgcgcagacgctgcatctgccaggtggtttccgcccaccagacacgcagtgtagtgcggctttcgctgaataccgtctggtcattagcggtaatcacaaagcgatcgccagccagggcctgaccaaggtagtggacgcagtcagcaaggccgtactgcgccaatagcgcttcgaccgcgtctctgtcttcagcgcgtacctgaatcacgccgcccagctcctcgttgaacagtgcggccagatggtcatcgcccagcgcggcaatatcgacctgcacgccgcagtggccggcaaaggccatctcggccagcgtcaccagcagaccgccgtcggaacggtcgtgccaggccagtaatttacgcgcagcgaccagcgcctgcatggcgtcatagaagcctttcagttgcgcgacgtcacgcacgtccgcgggtttgtcgccaagctgacgatagacctgcgccaacgccgttgcgcccagcgcgttgtggcccttgccgagatcgatcagcagcaaggcgttatcttccgttgaaagctgcggcgtaagggtgtgacgcacgtcttccacgcgggcaaacgcggaaatcaccagcgacagcggcgaggtcatttcgcgctgttcgttgccttcctgccagcgggttttcatcgacatcgaatctttgcccaccggaatagtcaggccaagctgcggacagagttcctctcccaccgctttaaccgcgtcatataaaccggcatcttcgccaggatgaccggctgccgccatccagttagcggaaagcttaatgcgcttgatatcgccaatctgcgtcgcggcaatgttagtcaacgcttcaccgacggccagacgggcggaggcggcaaagtccagcagcgccaccggcgcgcgctcgccaatcgacatcgcttcgccgtagtagctgtcgaggctggcggtagtgaccgcgcagtcagccaccgggacctgccacgggccaaccatctggtcacgcgccaccataccggtgacggtacggtcgccaatagtgacaaggaaggttttttccgccacggtcggcagatgcagaacacgctttaccgcgtcggcaatcgtgatatccgcgcggttcagcgcatcgcctttcgccttcaatgtttgcacatcgcgggtcattttcggcgttttgcccagcaggacatccagcggcaggtcgatcggctgattgtcgaaatggttatcatgcaacgagagatgctgttcttcggtagcgtcgccaatgaccgcatacggcgcgcgttcgcgcttacacagttcatcgaacagcggcaactggtcagccgcgaccgccagcacatagcgctcctgggattcgttacaccagatttccagcgggctcatgcccggctcgtcgctaagaatgtcgcgcagttcgaatttcccgccgcgcccgccgtcgctcaccagctccggcatggcgttggagagaccgcccgcgcccacatcatggataaacaagattgggttagcgtcgcccaactgccagcagcggtcgatcacttcctggcagcggcgttccatttccgggttgtcgcgctgaacagaggcaaaatcgagatccgcatcagactggccggaagccattgacgatgccgcgccgccgccgaggccgatattcatcgccgggccgccaaggacgatcagcttcgcgcccacgacgatctcgcctttctgcacgtgatcggcgcgaatattaccgatcccgcccgccagcatgatcggcttatggtagccgcgcagctcttcgccgttgtggctgttcactttctcttcataagtacggaagtaaccggtcagcgccgggcgaccaaattcgttgttaaacgccgcgccgcccagcggaccttcggtcatgatatccagcgcggtgacaatacgttccggcttgccaaaatcctcttcccacggctgttcaaagcccggaatacgcaggttggaaacggagaagcccaccagcccggcttttggtttcgcgccacgcccggtggcgccttcatcacgaatttcgccgccggaaccggtcgccgcccccggccacggagagatggcggttgggtggttatgcgtttcgaccttcatcagaatgtgcgcgggctcctgatgaaaatcgtaacggccggtattgtggtcggcgaagtagcgccccaccgcagatccttccatcaccgcggcattgtctttataggcagagagcacatagtccggcgtggtttcgaaggtgtttttaatcattttaaacagcgacttcggctgcggtttaccgtcgataatccagtcggcgttaaaaatcttgtggcggcagtgctcggagttcgcctgggcgaacatgtacagttcgatatcgttcgggttgcgccccagtttggtaaacgcctcctgcaaatagtcgatttcatcttccgccagcgccagaccaagacgcaggttggcgtcaattaacgcctgacggccttctcccagcagatcgacactggaaaccggcgcaggctgatggtggataaacagtttttccgcatcggttaaagaagagaacaccgtctccatcatacggtcgtgcagctctgcggccacttgtcgccactgttccgccgtcaacgtcgaagcctcgatatagtacgctacgccgcgctccagacgatcaacctgttgcaggccgcagttgtgggcgatatccgttgcttttgaagaccagggggagatggtaccaggacgcggtgtgaccaacaggagtttacccgccggcgtatggctgctaagcgccgggccgtattgcagcagacgggtaagctgcgcctgctcgctatcatttaacggggcgttcaggtcagcaaaatggacatactcagcgtatatattgtggacctggaggttggcagcctgaaagcgcgccagcagtttattgatacggaatgcagacagtgcaggcgaaccacgcagaatttccatcataagtctctcgtcttctaagctttggtgtgcgcaaggggggaaacggccgtcattataaagaatctgacgcgccgacgaaaccgtttgcgtagaaataaaatcaccgctttttcttgtcatacggtgcggctatcgttgcgaataagttgccaactggcgcattgttacgcaaaatgccgctcattaatgacttatctattgcagcaaaacatctttttcagcccgaggcaacgcacgatccagagaattaactaattgaaaaaattaaagattaattatctgttcatcggcatattgacgctgctgctggcagcagccctttggccctcaatcccctggttcggtaaaaccgaaaaccatatcgccgcgattcaagcccggggggtactgcgcgtcagtacgatcgactcgccattaacctattccgttatcaacggtaaaaaatatggtctggactatgaactggcgcagcagttcgccaactatctcggcgtgaagctgaaagtgacggtgcgccagaatatcagccagttgtttgacgatctggataacggcaatgccgacctgctcgcggctgggctggtctacgacagcgcacgcgttaaaaactatcagcccggccccatgtattattcagtttcgcaacagctcgtctaccgggtcggacaatatcgcccacgttcgctggcgaccgttaacgagaatcagcttaccattgcgccagggcacgtcgtggtcaatgatttacagcgtttaaaagagacaaagtttcccgacctgagctggaaagtggatgataaaaaaggctcgacgacgctgctggaagaggtcatcagcggcaaactggattacaccattgccgattcagtggcgatcagtctgtttcagcgcgttcatcccgagctggccgtggcgctggatgtcacggatgaacagcccgtgacctggtttagccgactggacgacgataatacgctctccgccgcgctgctcgattttttcaattcgatcaatgaagacggttctctggcgcggatcgaagagaaatatctgggacatggcgatgatttcgactacgttgatacccgctctttcctgcgagcggtagataacgtcctgccggagctggaaccgttatttaaaaaatatgccaaagagatagactggcgcctgctggcggcgatttcttatcaggaatcacactgggacccgctggcgacctcgccaaccggcgtgcgcggcctgatgatgctgactaaaaataccgcccaaagtctggggctgaccgaccgtaccgatgcggagcaaagcatcagcggcggcgctcgctatcttgaagatatgatggctaaagttcccgaaaccgttccggaagacgagcgtatctggtttgctttagccgcctacaatatgggttatgcgcacatgctcgatgccagatcgttgacggtaaaaaccaaaggcaatccggatagctggaccgatgtgaagcagcgtttgcctctgttaagccaaaaaccgtattacagtaagctaacctacggttacgcgcgtggacatgaggcttatgcttatgtggaaaatatccgtaaataccagataagtttggtggggtatttgcaggaaaaagaaaagcaggaagcggaagctatgaaactggcgcaggattacccggcggtgtcgccggaggagctgaataaagcccccttccccttcctgtcgtttttatcgcagtcatcaggctacctgacgcattcgccgtctttactgtttacgccgcagaagaaagaagaaaaatagcgcgatggtcttatcggatggcgacgcgcaacgtcttatccggcattgcgctatactgccggccccgcgccttccgcacggtcggctttcttcagagctttaatttcctgacgacgcatacggaaaaaatcactgagcagcgtcgcacattcatcgcgcaacaccccttcaataatctcgacccggtgattcattcccggatggtgcagcacgtcaattagcgatccggccgcgccagtttttgcatcgcgcgcgccaaagacaacgcgtccaatgcggctatgcaccatagcgcctgcgcacatcacacagggttccagcgtgacatacagcgtggtatccagtaaccgataattctgcaataccagaccgccctgacgcagcgccattatttcagcatgcgcagtaggatcgtggcggccaatgggtcgattccagccttcgccaatgacgcgatggttatgcaccaataccgcgccaaccgggacctcgcgttcgtcccaggcgcgtttcgccagcgtcagcgcgtggcgcatccagtattcgtgatctaattcgacatcagacaaagaggtaactccggtaatgaaagcgggcggcattatacacagacgctatgcgtttcactattcgagctgctgcaactcgccgtgcggcgtcacccgccagcgatgctggcaaaaataaagcagcgggttatcctgtttgctgtcgctgtagccgctataaagacgcagcggcgtaccgattttacgttccagttgcgcgactttttcatggcccagacagcgcacggttaatacccagccgccataccgtcgcgccatctggctggcgatgaggttaacgcgcggcagccacggcgtatcaaaatagacttgctctaccaatgattgcggagaaccggtaataagccagatatccgcgtcagagctcaatagataggtggtcagacgctcctgtacaaccggaaacgccgtgacgttagcgcgaaaccaacggacaaaatccgcctgatgcgcctgcaaacgcgtttcgctatggccaaaagtacagccccacaacaacagactcatcggccagcgggccgcacgcccttttaccagtaaaccgataccgataatgggcaacaacggcagtacgagcagcgcatttagcggctgacggcgcagcaaataacgcagaaaactgccgaacatatcctgttgatgtaacgttccatccaaatcaaaaaagacgacacgacgctcgtggctgaccaaaccttactcctctggatcattgaaccccagcagccaggtaaaaataaacccggcaattaccgctattaaatagcctaacagatagaacaggacttttccggcaacaattgttaatgccagcggcaaaccggaaataccaaaggtaattaccgtcgccactttccagtagctgatcaacgccccgcctaccgcgccgccgaggcaagcgccaataaatggcttacccaatggcagcgtgacgccaaaaatcagcggctcgccaatccccagcagtccgacaggaagcgcgcctttaatcacctttttgagtcgcgcattgcgggttttcatcagtacggcaatggccgcgcctatctgaccaacgcccgccatcgccaggatgggaaacagcgcgttatagccgtgcgcttgcaccagctccacatgaataggcaccagcccctgatgcagcccggtcagtaccaacggcaggaaggttccggctaacaccgcgcccaccagaaaaccgccgcgatcgatagcccaggacgcgccgtgagcgatagcgtctgaaatccagccgccaagcggttgcagagcgacaatcgctaccgcgccggtgataacagtcgtcaataaagggttaagaattaactccagcgaccccggcagcagcttacggaactggcgctcaatccagcacattaacgccaccaccagcaggacggcgataacgccgccccgtcccggctgaagcacctcgccaaagagcgtaatctgcgccagttgcgggctggaaaggatccccgccatcacgccgcctaacgcctgcgatccgccaaagactttcgcggtattgacgccaaccagaatgttcatgatagcgaacaccgcgctaccaaatatccccatcaggcccagcaggttaggataatggacggcaacatcgccgacgatatccggacgtttaagaatgttgataatgccggtaatcaagccggatgcgataaaggcggggataagcggtataaaaacattcgccagcttacgcaacgcatcgctcatcggcgctttatacttcgctttcgcctcggatttggtacgcgccatagcgtcatccggttttacaccacctgcggcaatctgcacgcgcatcgcatcaaccacctgcgcagccttccccggcccaacgatcagctgatgttgctccccttgctttacgtatccactgacgccaggcaacgcttttaagcgcggaatatccagttggctgtcgtcctgtacctccaccctgactcgcgtcatacagttttccaggcgcagaatattttgctctccgccgataccacgtaaaatgtcgctggcgagcgctgccgtcttatccatacacacctctttagtgttctaacgccgcccttaaaaagccctgatgagcggcaagtttttccctggcggctgcagcatccagccccgtaagcgccatcaaaatggcgggcttaacctcaaaatcggtctgtttcagcaacgcttctgcttcttcacgacctatcccggtcgcttcaacgaccatccgacacgcgcgatcgaccagtttgacgttggtggctttcatatccaccatcaggttttgatagaccttgccgaatttcaccatcgcgccggtagaaatcatattgagcaccattttctgcgcggtgccggatttcagccgcgtggagccggtaagcgcttccggcccgacaacgggcgaaatagcgatattagcctcccgcgcaataggcgaatctggattacaggagacggcaacagtggtacaaccggactgtcgcgcatagcgcaggccgccaatcacatagggtgtacgacccgacgccgcgagccccacaaccagatcctgttcttgcagatttagcgcgacaagatcgtcttcgcctgcctgttggctgtcttccgcgccttcgaccgctttcagcaacgcgcccggcccaccggcaatcagcccgacgaccagaccgtgcggaacgccaaacgtcggggggcattcagaggcatccagtacgccaagccgaccactggtgcccgcgcccatatagatgatacgtccgccagacttcagcgccgccgcagcggcatccaccgcacgcgcaacgtcaggcagagtggcttttaccgcttccgctaccagcgtatcctgttcattaaaacgcttaactaattcaggagtaggcaacgcatccagatccatcgtttgcgggttacgggtttcagacactaaggtaccaagattcatttttgtccctctggaatttttaattcataataagcgtccatgatggaatagaatattcccccaggcgagtgaaatttcgttttgtcgtcgccatcacgtttcgcaggagctgcccatgaactgtttgattcgtattcgccagcgttatccggatctcgcgcaaagcgacaggaaactggcggattatctgctcgcgcaaccggatacggcgcggcatctgagctcgcagcaactggcggctgaagcgggcgtcagccaatccagcgtagtcaagttcgcgcaaaaactggggtttaaagggtttccggcgttgaaactggctctcagcgaagcgttggccagcaatcctaatccgcattccgttcccgttcataaccagattcgcggcgacgatccgatgcgcctggtcggggaaaaattaattaaagagaatgtggcggcgatgcacgccacgctggacgttaacagtgaagaaaagctgttagaaagcgtcacgatgctgcgccacgcccgccgtattgtgatcaccgggattggcgcctctgggctggtggcgcaaaattttgcctggaagctactgaagattggcattaacgcggtggttgagcgcgatatgcacgccctgctggcgacggtgcaggcgctggcgccggaggatctgctgctggcgatctcttattccggggaacggcgcgagctgaacctggcggcggacgaaacattacgcgcaggcgcgaagatcctggccattaccggtttttctcccaacgccttgcagcagcgcgccacccgctgtctgtatacgattgctgaagagcaggcgacgcgcagcgccgctatctcctcgacacatgcgcaaatgatgttgaccgacttactgtttatggcgctggtacaacaggatttagagcgggcgccggagcgtattcgccatagcgaggcgctggtaaaaaaactggtttgaaaatggctcttccgcctcatgcagaagagctatcaagtttattgcgcttctttagcgtgaatcaattgcgtcaggagtttgttaaccggtacggcaatattgttctgagcgccgattcgcgcaatcgcaccatttaaatagtcgatttcggtcagtcggcctttatgtaaatcctgatgcatagaaggatagtggtggccgctctcacgcggatcgaacactttcttcaccgtattcatcaccatttgctcagtcaacggaatattctggctggcagcaactaacacaaactcatcaactaccgcttgcgctaaatctaaagcaccaggccgctgaccaaatccgccgacattacaatccagtaacgcgcaataggtgttcattacgctattaaaggctgctttcttccagatcgataataatacgtcagggcttatttcagcattcaatccagcactattaagggtggcaatgaccttagcctcttgagccgaatcctggctggctatcggctgcagttcaatcgttccggtaccggtggccataatatgcccagccccctccagttcgctggaccataacgtcacacccgcatagattttctgccgatcgacatatttctccagggtttcgatatttcccaggccgttagataaaatcatcacgaccttcgcggctggcagcagcggcttaatacgctgtaacatgctatccaactgcatggctttggtaaacagaataaccagctcaaactccccctgggattcatcagccaacatagcagggatggggtaatacttctgagtcgtttccgtttcgacaaacaaccccttgctacgaatagcgtcgacatgctcctgccagccatcaataagcgtcacgtcgtgcccggcctccagcagcatatagccaaaacgacatcccatagcgcctgcacctgcgattgcaattttcatttttatttccttattatctgattaatgaattttggctaaaaccgttgcgacatattttttcgttatcagggtcaacacgactccaataagcaatagcaccgttgtcaaaataaatactgtattgtagcttccggtatattttgcaatagcggacgtgacgtaaggagcaataaccgcaccgacggcaaaaccaaaatacataaagccgtagtttagtccctggttacgcataccaaaattctggctggtcaagccagggaagataactaatataccggcataagcaaagcccacgcccagagcgctgaaatagaataccgaagtattaccgttgaagaacaacagcagcagcatacagacgcaggtaaaaagataaacaataaccagcgtattatagccgcctaatttatcggttaaccctccccagaacaggcgaccgatcgagttaaatatcgagaccaggctaacgactaatgcaccggacagtaaaccgtactgcgtcataccaatttgcgcagaacttgagctaattaccatcccagagaacacgcccagcgccagaatcataaacagcagccagaagcgcagatctttcagcatgtgccgatagtctttatccagtggcgaggctttaattcctccgctatcttttgctggcgcgctacgaataaagaactggacgataaaaataaccaccagataaacaatacccagatataacaacgcccgactaacatcatgagtttgcgccataaaatattcggccaggcgggtgcaaagtagcgttccgacgccaacacccgccagtacgataccgctggcaagaccgcgacggtcagggaaaaatttcagaatattattaagattacccgtaaaagccaggcccgatcccaacccggcaatgacgccgtaggttaaaaacagcatgggcaaattatccacaaacccggacaagataaaacctaaagaaaacaggataccgccgataactatcgcctgctttcctttaccattgtcgatcattctcccaccccaaatcatcggtaaaggaatgatccccatgttgatagagaatgctaacgccagcgtagccggatcccagtgatattgcgccatgagtggtgttttgaaatagctaaatgcgtagacgcccccgagcacaaaattgatgcacacgtgagcggcaagcattccccagcggttgattgatgccgacataattttccctttttaaaatgcactgatcacagtttaaaaaaagcaaaataggcaaacaatttggtattttttataatcgttataacaaaacccaatcgattggcattaaattttaatgaatatcaaacaactacattccttcctgatattgtgtgatgaattacattatggtcgggcagccagtcgcctgtttatcactcagccatcattaagtcagcaaatcaaacaacttgagtcatcacttaaaacaatattatttaagcgaaaaggtagaggaattaaattaacaaaagcaggcattattttgcaacgacacgctaacaaaataatgctggatttaaaaaatgccgaaaatgaacttcttccctatcaggatcaacagcgcgatactatttcaatcggggtgtcaggcagctacctggtcctgcccgcttttcgcaactttatggcgcaccatccggaaatatctttaaatgttaaagagttctcaactgagcaaaccattaaaaagctgacggatagcgccgttgatattggcattgtttatcgaacagcgctccctgcccagctaagctcgaccatgctgtttgaagatgaaattatcgctgcaatcccactttctcatcctctggcgacacgcgaacgtctgcatctaaaagatttaaacgaccagcccattatcgtgcttaatgactctctgctattaagagggatcatcaccacagaatttaataaccgcaaagtcgttcctaacgtcatctgcgaactggataaccactactcatgccttgagtatgccgaagcgcagattggcatcgcatttattacccgctcgctaacccatttatcgacacccaaaaatgttcgcctggtttcactgggcatccccgcattctttattcctgtcatgctggtgcacagtaatgacctttcactggataacgcaaccatctgcctgctcaagcagatcaaaaatttttacactgtagataacaaatcagcgccagaaaagagctggcccgagcagaaaataggcgtataatgcccgcccgatttgtgttgtttctgagaatttcctgatggcgctgttaatcaccaaaaaatgtatcaactgcgatatgtgcgagccggagtgcccgaatgaggcgatttcaatgggcgacagcatttatgaaattaacagcgacaaatgcaccgagtgtgtaggccattacgaaacgccgacctgtcagaaagtctgcccaatccccaatacgattttgcaggatcccgcccatgtcgaaagcgaagaacagttgtgggataagtttgttctgatgcatcacgcagataaactgtaagcgggttaacgtatttccaacgcaacaatgtctgatggcgctatgcttatcaggccgacaatatatcggcctgtaggtcagataacgtgtttacgccgccatccggcaaatctaactttccagaatgaccgtagcgcaggcgtaatggcgttcatcggccaacgtgacatgcatgtgcgccacaccgagtttttccgccagcgttaacgcctcgccccacagccgcaaacgtggttttcccagctcatcgttaaacacttcgaactgattgaacgccagaccgttgcggatgccggtgccaaaagctttcgctgccgcctctttgaccgcaaaacgcttggcgagaaaacgcaccggctgctgatgcgtctcccagatagcccactcgttgtcactgagcacacgccttgccagacgttcgccggaacgggagatcactgcttcaatgcgggcaatctctacaatatccgttcccaggccgagaatcgccattagccgcgcgcttccagcatcaaacgtttcatttcagccaccgcctctttcagccccgtcatcactgcccgaccaataatggcatgaccgatattgagctcgtgcatttccggcagtgcggcaatagctttgacgttatggtaggtcagaccatgacccgcatttacttttagccccagacgggccgccagggtcgcggcgctggcaatacgcgccagctcttttgcctgttccgcatcggtttctgcgttggcgtagcagccggtatggatttcgataaacggcgcgccgacttccgccgccgcgttgatttgcgtttcatcggcatcgataaagagcgaaacctggatgccagccgccgccaggcgcgcacaggcatcacgcattttatcgcgctgtccggccacatccagaccgccttcggtggtgacttcctggcgtttttccggcaccagacaacagaaatgcggcctggtttctacggcgatcgccagcatctcttcggtcaccgccatctccagattcatacgcgtatgcagcgtctgacgcagaatgcgcacatcgcgatcggtaatgtggcgacgatcttcgcgcaggtgtacggtaatgccgtccgcgcctgcctgttcagcaataaacgccgcctgtaccggatccggatagtcggtgccgcgcgcattacgtaacgtggcaatgtggtcaatattgacgcctaacagtaattcagccatgacaatcctcgttaatctttcttcgtttttactgtgcgtttgggcataaattgccggaacagctcccggctttttaacggttttcccccaagatacggctttaatgccatacgggtaaagcgtttagcggcacgcagggtatctacatccggaaattcccgcgcctccagcgctttcaggtgccgtccggtaaaggtgttgttatcgatgacgacgctggcgaaaaagcctttttcttcgcggtaacggtaggtcatggtgtcatccacccgttcgccgctgcctgcacagtgggtgaaattgacgccataccccagatgacccagcaacgccagttcgaaacgtcgcaacgccggttcaggcgagccggtggttcccgccagcgcctgaatacagttcagataatcaaaaaagagttcggagaagcgcgtttcatattccagtacgcgagagaggagttcgttgatatacaggccgctatagagcgtaataccgcttaacggcagcgccagagaaactgcctcggcgctgcgcagggttttcacctcgccgcgtccgctgtagcgtaacaataacggtgtaaaaggctgtaacgcgcctttcaaattggaacgtttagatcgcgcgcctttggcgacaaggcgcactcgccccgattcttccgtgaagacgtccagcatcaggctggtttcgctccaggggcgactgtgcaggacaaatgcgcgctgccacccttccacgctgtgttaactcacagatcgtctacgtaaccgagactgcgcagagcgcgttcgtcatcggcccagccggatttcactttcacccacagttccaggtgtaccggcgcttcaaacatctcctgcatgtctttacgcgcttcaataccaatggttttgattttggcgcctttgttgccaatcaccatcttcttctgcccttcgcgctcgacgaggatcagcccgttgatatcatagccgccgcgttcgttggtaacaaaacgttcaatctcaacggtaacggaatacggcagctcggcgccgagaaaacgcatcagcttttcacggatgatttcagacgccataaagcgctgagagcgatcggtgatgtaatcttccgggaagtggtgaatcgcttccggtaaatgtttacgcacgataccggcaatggtatcgacgttcatacccgtttcagcagagatcggtacgatatcaagaaagttcatctggcttgccaggaactggaggtgcggcagcaaatcgactttttcctgcacgttatccaccttgttaacggcgagaataaccggtgctttgccatcgcgcagtttgttcaggaccatttcgtcgtccggcgtccaacgggtgccttccacaacgaaaatcaccagctcaacgtcgccaatcgaactgctcgccgccttattcatcaaacggttaatggcgcgcttttcttccatatgcagacccggggtatcgacatagattgcctgatacgggccttcggtatgaataccgacaatgcggtggcgcgtggtctgcgctttacgggaagtgatcgaaatcttctgcccaagcagtttgttcagcaaggtggatttgccaacgttcggacgtccgacgatggcaataaatccgcagtaagttttgtcagtgctcattccaactccagttttttcagcgcctgttcggcggcagcctgctccgccttacgacggctggaacccgtgccaaccaccggttcgctcaggccgctgacctggcagtggatagtaaattcctgatcgtgcgcctcgccgcgtacctgcacaaccaggtaagatggcagcggcagatggcgaccctgcaaatactcctgcaagcgcgttttcggatctttttgtttatcgcccggacttatctcatccagacgggttttataccagttaaggattaactgctcgacggtctggatattactatcgagaaatactccgccgattaacgcttcaacggtgtccgccagaatggactcccgacggaatccgccgctttttaattcgcccggccctaaacgcaggcactcgcctaaatcaaattcacgggctaattccgccagcgtattaccacgtaccaacgtggcgcgcatacggctcatatctccctcatccacccgtggaaaacggtgataaagcgcgttagcgataacgaagctcaggattgaatcgcctaaaaattccaggcgttcgttatgtttactgctggcgctgcggtgagttaatgcctgctgcaacagctcctgatgattaaaagtgtagcccagcttccgttgaagccgattaattacgatggggttcatgcgataccaataaatgaatgcgtcaacaatccagcacacgaaacagacctgatacacgtcatctgtcctgccgcatcgctgcagcggaaagaaggttgtctataaccaacgctgtttcgtgtgccgtggcgaccaaacggcgccaacctaaaacttcgggggaatattctatacacaacgacaggggatgtcgttagtcttagggaatttatccaggaaataattcacgctgccgctaaaaagacggcagcgtgaacgatcatttcatcacagttagtgaataccgccgatacgactcaggcgtacgcctgtcggccactccccttcctgcttgtcaaagctcatccagatagcgaccgctttaccgaccagattcgcttccggaacaaatccccagtaacggctatccgcgctgttatcgcggttgtcgcccatcatgaaatattgtcccggcggtacaacccaggtcgccagcggttgtcctggctgttggtaatacatgcccaactgatcctgagctatcggcaccatcaggatgcggtgcgtcacatcgcccaacgtctctttacgttcggtcaggcgaatgccgttttctttcgtctcgtttagcggaacttcaaaaaaaccgctggtcgcttctccgccgttacggcgggcaaaagtctgtacaaaatcgctcggctcaacgttagagtaggtaaccggcagcgcattttcgcacgcctgaccggagctacagccaggctgaatcgtcacctctttcgcaaccggatcataagtgattttatcgcccggcaaaccgacggcgcgtttgatgtaatctaacttaggatcttccggatatttaaataccacaatatccccgcgctttggatgaccggtctcaatcagggttttctggtagatcggatctttaatgccgtaggcaaatttttccaccagaataaaatcgccgataagcagtgtcggcatcattgagcctgacgggatctgaaagggttcataaagaaatgaacgaacgatcagaacgatcgccagaaccgggaaaaccgacgccccagtctccagccagcccggcttaggcgccactttattgagcgtagcgttatccagcgcatctcccgacgccgtttgcgcggcagcctggcgcgcccgacgttttggcgcgaaaacaaacttatcaacgcaccataaaatgcccgtcaccagtgtggctatcaccagaatcagggcaaacatgttcgccatgccaactccttagggattatttattgtctttaccgacatgcagaatggcgaggaacgcttcctgaggcagctcgacgttaccgatctgcttcatgcgtttcttaccttctttctgtttctgcagcagttttttcttacgactgatatcgccgccgtagcacttcgccagcacgtttttacgtaactgttttaccgtcgaacgggcaataatatgcgtaccaatcgccgcctgaatcgcgatatcaaactgctggcgtgggatcaaatctttcatcttctccaccagctcgcgaccacggctttgcgagttatcacggtgcgtgatcagcgccagcgcatcgacacgctcgttgttgattaacacatcaacacgcaccatatcggaagcctggaagcgcttgaagttataatccagagacgcatagccgcgcgacgttgatttcagacggtcaaagaagtcgagcaccacttccgccatcgggatttcataggtcaacgcgacctggttaccgtgatacaccatgttagtttgtacgccgcgtttctcaatacacagcgtaataacgttacctaaataggcttgtggtaacagcatatgacattcggcgataggctcgcgcagttcataaatgttattcaacggcggcagcttggaggggctatcaacatagatagtctctttcgccgttgtttctacttcatacaccacggtcggcgcagtggtgatcagatccagatcgtattcgcgttccagacgctcctgaatgatctccatgtgcaacaggccgaggaagccgcagcggaaaccaaagcccagcgccgaggagctttccggttcataaaacagtgaggcatcgttcaggctcagcttgccgagcgcgtcgcggaaactttcataatcgtcggagctgaccgggaacagacctgcatagacctgcggtttcaccttcttaaagcccggcaacgctttttccgctgggttacgcgctgaggttaaggtatcgccaaccggcgcgccgaggatatctttaatggcgcagaccagccagcctacttcgccgcacttcagctcggtacgatcaacctgttttggcgtgaagatccccaggcggtcagcgttgtaggtctgcccggtgctcatcactttaattttgtcgcctttacgcatggtgccgtttttaatacgcaccagcgataccacgcccaggtagttatcgaaccaggagtcaataatcagcgcctgcagcgggccgtccggatcgccttgcggcggcgggatatcgcgcaccaggcgttccagaacatccgtcacgccgacacccgttttggcggagcagcgtaccgcgtccgtcgcatcgataccgacaatgtcttcgatttcttccgccacacgctccggatcggcggccggcaggtcaatcttgttaagcaccggcaccacttcaagatccatttccatcgcggtgtagcagttcgccaacgtttgcgcttctacgccctggccggcatccaccaccagcagcgcgccctcgcaggcggctaacgaacgggaaacttcataggaaaagtcaacgtgtcccggcgtgtcgataaagttcagttgataagtttcaccatcagacgctttaaaatccagcgtcacactctgggctttaatagtaataccgcgctcacgctcaagatccatcgaatcaagtacctgagcttccatttcacggtcagacaggccaccgcagatttggataatacggtcagacagcgtcgatttaccgtggtcaatgtgagcaatgatggagaaatttcttatgttcttcataaatatgaatttttcaactcgctatgctgataaatttttcttgatggacacagcggtggacattccacaataactaccccatcaacgactggcgtgcatattacactgtagctttgaaatcgtcagcatacgatctgctgatcaacatacgatgttacatcacaatagaggtctatacgatctataaacctataaacacggttacagtcagtcctgactaaacagcagccggcctaccgcagtcacgttcttgcagacaacgtgactgcggtaatccatcccaccggattgtcttcaaattctccatgttgctgaatcggctaacagcttcttaaacgatcggtattaggctaggttctaaatcttgcctgaatgaaaataaatgtaataatgatagcttggtattgacatatagattgaaaaagcgcatgaaaataggattccaaccagccatattgcaatatgcatatacaagtaacgaggcgacatcaaaccttgagttattaaataaatggagaatagaatccccagatattgagaaggaggagcgtaatagtatttacgacaaaataatagaagcaaatcataccgggagcttatcaattactgctcatcatgttacctctattccggtatttcctgataatttatccgaattgaatttatcttcatgctatacactggagtctattccaaatcttcctgatgggttaaaaagtttaactatatctggaaatcagaccattaaaatttcatatttcccagatagcttagagtcactatctatagatatgcaggcatatgaagaaaattatactttccccgcattaccttatggattaaagagttttactgcatgctatggtaaatttttgcctccccttcctccgcatctatcttctttgtcattgcaaaatttctctgaaatattatgtgctgagttaccatataaattagataaattagatttacaaaattgccctttcttgccattaatgaaaatgttacctgaggagttaaaagaactaagtattgaacttatacgaacagttcccggtactgttatagatgatattttgcctgataagctaaaaaaattaagtatcaacttttgtgataatattaaacttccagttaagcttcctgttaatttaaagtctatcaatttatcctcaaggacccctattgcatgggaaataccaacctgcaatctgcctgcacatatagatattagtaccgatggttatgttaagcttaatcctgaatttcttaccaggagtgatattacctttagtaacaaacctgcaggagatgtgttaagttttcagcctggagatgtggtttatggtttatgtaaggcaagagatcgagtaaatactttagttaattcgttatattatttttcaaaaaaagatattattattcaaaatacattaacagatgcggtctgggacaggaagaatagagccgtgtttaataaagatgagaagatagcagaaagattgaatgatgttcagagagggattttttttagagaatttttatctcaacataaaaaatacaatattaccgaagataaatattcagacttatccaatgaggagtgctggataaaaacaagtaaagccggtcttgaatttcaaacacgattgagggaacggtcagttatttttgtcattgacaatttagttgatgctataagtgatatcgcaaataaaacaggaaagcatggtaattctattacagcacatgagctaagatgggtatatcggaatcgacatgatgatctggtaaaacaaaatgttaaattttttcttaatggtgaggctatttcacacgaagatgttttttcattagttggttgggataaatataagcctaaaaatagaaatcgttgactttaaaaaaatatgcaattaatatatttatatatagagcagccctattggagttaaggatatatactccccctaactctagactacatgccaactttacttagtatcatattttcttgctacatatctgtttggcaagggtatgaataaaaaacaagattaatttaattgatatcgcaacagataagcacctgcatttatctttaaacttttttatggccaaccagatttttcaccatctgcgcacgtttattcgggcatgcgttgaaaacctgcaaaaaaagaaaaatatcgatgcttattattttttctttaattaaattttcgctcaacaaacttaattattaatccaatgacagtgaagtgtgaactatgctgagcataaacgacatcaatagcaagggcaagggcaagggcaagggcaagggcaagggcaagggcaagggcaagggcaagggcaagggcaagggcaagggcaatctgagtatttacaggtgaaattatgaaaaatagtatatttttaccattgcttctggtgctgtcggcaacgaccttttcggcattggtgatggctgccagtcattctccccaccagataatacaaaacatttttccagtggctggccgccagatatcctgaagcaactgaattggtctcaggtttgtggttgttagtatactgaatattacttcaggatggcatgttttattgacaccagcctgatttttcacaacgttatattacccgtttacagataattcccagctaataaatcaggaagttccagatgtaacagaagttatgaggtgtattaattgataggtctaacaggcttgaattacttttctttaaaaactactgcatgtaaaagggtctcctcttgttgtgatgagattcgtatatatttatatcttagtgatttatggatcatacttgtggttttccttaggaggtaacatgtttacaattaatagtactaacagggtggcgagcacaatcgctccatatgcatgtgtaagcgatgttaatttagaggacaaggctacatttttagatgaacatacctcaatacatgcgaatgattcttctttgcaatgctttgtcttaaatgatcagcatgttccgcagaatacattagctacagatgttgaaggctacaatagaggattacaggaacgtataagcctcgagtaccagcccctggaaagcattgtttttctactcggcacccctgcagttttagagactaaagagtctttatcattaccagtttccccggatgctttaacccaaaaactattaagcattagtagcaatgatgaatgtaaattatcaggtagcaccagttgcactaccccagccagtcataacccaccgtccggttatatcgctcaatacaggcattctgcagaggttttcccggatgaataaaacaaagcgttataaatagctgcgccgaatagtagatcactttgattgaactcagtccggattgtgtgatttgatcaatcgccaaaaatcacaaatcaccaaccggactaagcgatgccgatcatagcaccaattccccgtaccgaacgacgcctgatgcagaaaactatccataaaacgcgtgacaaaaaccatgcccgcagactgactgccatgttgatgctgcaacccgggagacagtatcggccacgttgccagaacgctctgctacgcccgttcacccattggacgctggattaactgattcaccgctgacggtgtggaggcgctggacaagtgtgatgcggataatcctcatcatatggtcatgtatttttcataaacaataaagctcgtccaggagtgcactaaataacagattgttagagcttgcttaaacatcagtcgtctaagtttaccttaaagcaagtggcgttttatgtcccatatatgccccatcacatcctcgttccatcatcaaactcactggatctcatgatgttgtagggaagtaagccggagagataatttccttctgtgccgtgccggcagaagaatttatctggcacgctgtctcgcgctgtatggagtgtgaagagccaacacccggaattgattgaacaagttacttaacacgcaatagctcagagtatcttgtggtgtaccgcagcgaaagtatttctcgcttcatagcccactgttgcggtatcccctgcccggtgattttctggttgtattgtcatgtgcgcatatttaagccagtttagagactgggaattttctgtacagcgtcgacagccccgcatcataaataatcgttacctgctgtcgcggtactcctgccctaatcaggcgcccggcctgcgctcccagtggatgggagccagtaaggatttgaatagcacatgaactcactctcatatgaattaatttacattggaaagaaaatataatagcgcttatcatttttatttaagttaaatattttataaatggtttttatttactcacctgatggtaatgaataacgtttaatatctatagtaaaggatgctgtaaccgtaaggatagtgtgccaaaatttaacaggcaacgtattattaaacacgttaagagcgtatttttagcaatgattttaatattaccatcttcactatattctgctcttacaatagcggcagactctcaagatcataaaaaagaagaaacaattaagccaatgcctcaaaagtggtgtaatctttggcctgctggcatacccttccctgaagattggtttaaaatgtgtagaggttattgagtataaatttaatatactaaccagtaaccatatcagttatgacagacaggtcttcttcatatttgctataaataaggcctgagctttcctgacaaattataaactactggctggtttctccggccagacaggctttaaagtatcaacacggtttacctgtacccggtactttctccatgccagaagagaagctttttctttatcggttgcttcgtccagatccactgcatcctgtaacggcgcgattttttcagatgccatttgcaaaagacggcttttggtcccttcagcttcacgaagtctggccgctgtttccgcagcttcatccttcacccacgccttaccatcccatttctggtattcaccgtctggtgaaactgatgtgacattttcaggtagcgggccgggagcggaaatataaacctgattgccggttgttgtgtcgtaaaccgtctcgccgcggtggtcctcatgcagactccacgttccggtttcagcatcaaatatcgcaatatgactggctggaatatccgggggcgcaatatccgtacaatttgccggtaatccagtgtgtggcgggatatatgcatcacctgcaccaataaattcgtttgtatctgaacgcagattaaaaattttaattgtctgcggggtatcgctcattttaaacgtcattttttactccggataaatattcaggtttcaggtgctttccatgagaattggggctaaggaaaacagcatggctatgcgcaccaatataaatatcatcaacctgatgacggggactgatgcaggtgttacctgattttttgcaatacgttctgtaatcaccaaaaccgatatattccgttctggcgttcggacaaagcgcctttgacggacagtatgccgttgtactgaatacagcattctggcgggcgctggcgtattgccagttaatttccgtggtgcagttaataaaaccatcccacgccagcttcatttgccgggcgacactgcccggggatacctgaccacacccggcccccatcgcagggaatactaccgatttaattttcctgtcttccccggcgcttttattgtgctgaaatatcgctaataacgctgcacgtgttgcattataaaccgcgtcggtgccgtcgattatcagcggaacgcgcatcgtcggggcgtgaaccagccacggatatttactgttacccgtttcaataacaaaggcggtgccgacgggctgttctcccagatattcacggaggatatgttgctgtacccgttcctgtaattgcggcccgaaatatgccgtaatagcagcatccacaccaccatccataagaccaaagctgttggccgcactgaccatgcagtcaaattccggtatggtttcaaacggtccggggataatttccacattttcggtattctgaaaagaatgttcaaaagccacggccattgctggcacgggtgctgaaagaattaatttaatcatgccagcctcactatgtagttaaatgcaatatttttaaccgtggtttccgcattaccgtctgcgtccacaataacgacgtgaccgtgtggaccgatatacatggtgtgctcgtgtcctccgatataaactgtatgcgcatggtcgccagcggcctgtgtccatgcaccacctccaggctgaaatgaggtgtgattggagtctccccagtatgaattgatataaccgccgaactggtgagtatggttgcccgtggtattggtcgatttcgtgccgtaatcaaaagatgaggtagattttgtccctaagtcagtatcctgcgcccgcgcggtgtgcgagtgcgatttattgccgtccatttcttgcgacaatacggcacgtccactgatgggcttaccctttattgtccagcctctcatgtcagggataacgccggacggatacgctatagccagtaacgggtaagcagatttatcgaaggactgcccctgcatcagagcgtaacctgccggagtagcatcagatggccatgcaatcgccgcccctactggatgcgaatccggaggtgggtttagtgtggtgtaaagcattgcccattcggaccactcagcatcggcggtatctcgatggctgcgaatatatgcgggcgctggcgcaccatttgtcccgctccagccaatgaggatttccccatcaccggttccggtcagacgtaaaatatttccgtattgcgtcggatagccattgttgtagacctcgcccattatcaggccgccatcgctgcctcttgtcgtgccagtcagtgccggaagcgcgccgcgtgatgcaagcctgttcgctgcgacagccgtaccaccagcaggcaacgcaccagcagccttatcaattgtgctccgtaaaccaacgtattcgataagaccttcaatgctttttcctgacagcgccgtcagtgtatcgtccagcggctgcttgcccgcaatcatgttagtgatagtggtagcaaaattaggatcgttacccagcgcgtcagccagttcctgcagcgtatccagcgactcaggtacggaaccgaccagtgcagcaatcagtttacgaacaaactcagcgtttgcagtctgaagtcccttagcgtcatctggcggcgtcggtgtggtcggcgttccagtgaataccggactgtccagcggcgctttggtctgtacctcgtccatgacagcatggaccgcctttggcgtggctgccagcgcttcgctgtcactgtccgtggcgctgcttaacttaacgataccttttttcgtcaggctggcatcttccagggaaatcacgtccgcgatgtcttctgcccgttttgcggcatcttctgctctggtggctgctgctccggcagcagtactgctttgcgccgccagtgatgcgctggtatcagatgcggcggcgtgattggatgcctccgatgctgatgacgaggcggctgttgcgctggccgctgctgtacttgctgacgttgcagcgtttgtctcagatatttttgctgcggctgccgatgcggctgccgccttttccgacgctgccgccgcagtggctgacgcacctgcatcaccggcactggaagccgcctgcgtttctgacgtcttcgcggcggtttcggatgctccggcgcgcgctgctgatgtctgcgccgccgtcgcgctggcggctgcggcagcagctgaatcgccggcggcagtacgggagacatctgcattcgcttcagatgttttcgctgcggctgccgatgcggctgccgccgttctggctgtgtcagccgacgccgcgctggctgatgcctccccggcttttgtggtcgccgtacctgcgctgctctccgcagatgctgcggatgaggctgcctgtgtggctgatgcttctgccgctccggctgcattcactgctgccgtggcgctttccgctgcctgacctgctgatgtctgcgcctgttcagatgcctgccctgcggcggtggcattccgcgatgcctccgatgcctggcgggcaacttcttccaccatcgcctcaaaacgtcgcagcgcctccgggcggacgtcgtcttccgtcatggcccccagaaaatcattcagggtgcccggttttgaatcatcgtagaccgtaataactccggcatgtgacgggggatacccttccaccaggagcgtgactgtgtactgcccctgctccacatccatgctgtagcgcccggcgtcatccggattttccgatgccaccgtattcacgaccaccgtcgtactggtccggcaggccttcagctgaatggtgcagttctgtaccggcgttcccgtaccatctttcagtacgccggaaataagtactggcatattgcctccataaaaaagcccgcccgcaggcaggcttcagattcattcacatctcagcactgattatccgggtcacgtaaatatgccggcagcgaacactggacgctccgcgtgattatttgtccctttgcctcgcggtgctgtttctgcccgcggtcagtaccggtataaatccgggtctggttttcaatattgctgttaccgcttcctcttccgttatcggcaacggcagcggtggaaaataaaacggacagggaaacccctgccgccagcgaaattacgcgcgacatagtcatatctgttccttgttaaacgaaagagaccggaaatccggtcagtttgtgaagttgttccccgaccgggaaaccatcaccagcggccagacggaagcagacgtggtgtactgcccacgaaccctcagagaaacgctgatatccacgacaggtgaagtggtgtagaccgaaaagacaacggtctgatacatggccggaagccctgcggtatacgggataacctccgccgttttcacctggccgttaatatttatcgtgacggtgatggcaccggagccaccgttacgctcacagttagccatcaccgtgatggttttccctatctgataggtggcgctgtcggtataccgtgttgaggtgctgcgttcgtcgttcgtctccctgatgctcacgccctgcatgacttttgagccgcagatatcaccgacaaactctcttgcttctatcacgccagaaaacttaccggaggtggcattgatttctcccgtaaacgagccagatacagcgttgatatgcccgctgatatccgcatttttcgcagtcagctttccatccggcgtcagggaaaatgccggaggattcccgccactggtaatggtcggcgcgctcagatatttcaggaacgcctcattcatgattatctggtcgccctgcatgacgaatccgggcgtctcgtttccgtttgccgggttaatataagcaatgcgatccgccgccaccaggaactggcttatcttcccgtcaggcatgtcttccatgctcagtccaagtccggccacataatatttgccgtctttggtctgctctattttgacgccccacatggcgttccatttatcgttagcatcctgccactccttcgaaaactgctgcagtttgctggcgttatcctccgtcagttccaccttctccagcagttccttacccaggtgactttcagttatctgccctttgaaaaaatccagatagcctgcggcatcgttgctggcctgcccggtcgcctccacgaatgcggatttaccgacctgatttaccgcccggatataaaaatagtaatccctgccgggcctgatattcacactggccgctatccagtacagcgccgttcccagatatcgtgcggcgttttccacctgatggatatccgtaatctgcgcgtctgaaaaccagaactcatactgcaccgtcgggtcgtataccgcctgacgcggtgtggctgtaatctggaaatagccaggggtgagttcgataaatgatggtgccgccggcgcggagatgctgaactgtgtgctggccgggtctccctgttgtccctggctgttcaccgccctgacggacagggtgtagcgccccggcgtcagcccccggaaccggtactgcgtatccggcgttcctgcgctgcttaccagccggtcactgccatcttccgccgccacgttcaggcgcaaagaaaacgaggcgcccttaacgactcgcggtgtgtcccagcgcgccagtacctgatactgtccctcctccgccagaatttctgtggtcagatgctgtatcgccgggggaacggtgccgtgaatcgttccgggttgcggatcgaatgatgccccgttgtccacgatggactctttttccggcacatgctgtacggcggtgatggcatacgttccgtcgtcgttttcccggacagccacacaccggaagagacgctggcgcagcgacggcagtttcagcccccagacgctgtattccgccacgccgtccggtatccggctgacctgaacctgcacaccgtcggtaacagactgcacgtccacgctgaccggcaagccttcgccatccatcaggcttatcagcgtggtgccggacgacggcagggtaatctccctgtcaagggtcagaatgcggcgggcgcggtcaacggacagaatccgcccgcccaggctgatgccggcataatcctcgtcgcaaacctcaatcacatcaccgggaacgtggcgcagcccctccgcacccacactaaaatcaaccgtctgggtttccagcagctccgtttttatcagccacagcccggcgcggtgcgcctgcccgcgactggtacagccaaacgcatccatttttaccagattgcgtccgtagtgactgatggcgaccgtgtcttccaccagttccgtggatgtctgccagccattatcagggtcgatccagttcacctctaccgcattatggcggtccttccgcgcactgaagctgtaacggaacggtgtgccctcatccggcattaccacattgctgcgggtataggtccagactgtatccgagggcctgtcctgcacgaaggtcatcatctgcccgttccacaccggcatacaacgcatggcggagcagaagtcggtcagcacatcccacgccttacgctgctgtgccagatacgcattaaaggtcatacgcggctctgtcccgccgaatccgtcagggaccatctggtcgcagtactggcctattgcatacagcgcccacctgtccacgtccgccgcgccgattcgctgtcccatgccataacggggatgtgtcagcacatcccagagacaccacgccggattattgctgtatgcaggcttgaacgtgccgtcccagatgccgctgtaggttcgcgctaccggatcgtaattcgacggcacatgaataatccgcccgaaaaaatggtaatttcgcgtcacctgctggctgccgaactgctcagactccacctgcaggccaattacggcggtgttgggatagcgctgccggacatcaataatctcggtatacgacgaccagaccgtgttgttctgtaactggtcagtggtactgtctgccgtcacacgtaccatccggataccaaatggccggggagggagattatccactatcaccgaggccagatactgtgtggttgttttcccggtaatcgtaatctctttttccaccacccactgaccatagcgctcaagatggatttgcagcctgaccgatgtcggattgcggtcgcccttgctgttggcctccaccagtgactgcacgccgaacgtaaaacgcaggcggtcaatatttgcagccgtgatggttctggtcaccggattgtcgtatttgacctgtacaccaagcaccgtctcggcgccggacgattcaaatccctccagcggggtctgttcctgctcaccgacgcggtataccaccttcacgccgtggatattcgtgttaccgtcgcggtccaccaccggcgtctggtttaccagaacactttgcagaccgttcaccgggccttctatcggtccctcgctgatggcatcgatgacgctcagcagctgcgtggatttaaggttatccggtgcctcgcggggcgtatgcccttttccgccgccctttcccatttattaccccgtaaaacgacaaaaccgcccggaggcggttctgtctgaatctgttctgttgtcagcggccaatcaccacaacctgaccaccatctccttcatcagcggtactgacttcctgggaaatcacgcgtgaccccacctgcatctcgccgtacagcaccggcaacgtgttaccgttggcaaccatattatccagcgacgagaaatacgtgttctgcctgccgttatcggtctgcctcatttcggacattttaggttttggtgccagcatctgcgccacaccgcccagaaccatcgacgccccggtcatatacataccggataccgccgccgctcccagccagcctgccgggttccaccaggcaacggcaatcagcgccgcaccaagcaccgcctgaaacaccccgccagatttggccccgcccagacgcggcacaatatgaatcaccgcgccaggcggcagcgggtcatgcaggctggttgtcagggtatcagccgtaacatcgtctccggctatgcgtacctgataccagccgtcgttcagtttctgccggagaccgggcaactgtaccgccagtgcccggacagcttcagcaccactggctacctgcaggctgacgcggcggcaaaatcgttgcagatccccgtaaaggcagatgcgcgccatgcccggtgtcgccagatggagtgcgtgcgtcgttgccatttgtcggtatacctctcacgtttactcagttgttcaggaatatggtgcagcagctctccgtcgccgcagtaaatcgctgcgtggttcggaacggaggagccaaagcagcaaatcaacacgtcgccgggctgcgcactggctgcgctgacacggtaaaaccccgtcgtctccagattatccagatagagattgtcaccatgccgccaccagtcgtcgtcccggtgaaaatccggcatatcaatccccgccagatgataggcatcacggaacagcgtgtaacagtcaaaaaccccatgtttataatgccgtccggtcaggtgtggcacacagcggaatttatgtacctggccggcgcataccagccaccacggcaggtcgctttgaacctgcagcctgcggtccacatcgctcagatacggctggccgccaggatggctgtgaaccagcgccacaatatccccctgcgtttcagccctcagccagtcctccggcgccatacggaaataatcctccggcgcggcagaaatattcacacaggggagataccgttctcccgcctgtgttctcaccacgaagccgcacgactccgcaggcgcacaccgtcgggcgtgcgccagaatatcctgttctttcatgatgatttactgtgaaagtttattaatggagaggaaaccgccaaagtttccggtattgttacgcagggcgcatccccgggcgcagcggctgcaggcatcttttgccggatcggcggtagggttatcaaattcatctgcgacagctggtcccgtataaccgcattcgtcagagcggtatatccatgtacaggtattggccagcataattcgcccggggaagacacatccgtccgtttcagtcggtgttgccaggacaaatgtcgcacttaccgccgtcagatcactgcactgctcgatcacccatcggcttacggattcctgctccgggtcagcctcctggttgccgttttgaaaattcacggcatcgagaaaccgggcatatactatcctgcggatgaccgtcgccccaaccaggctatgcaaatcctccaccattccggtcaccataccgtaaagattggataccttcagtgacgggcgcgcagctgcgcctttgccgttcatttcaaatccgcaaccgtctacaggataaacgtcatatttccgtccctgccaggtaaccgcctcccccttttcatttgcctcgttacaaaaaaaataacgatcaccgccagactgtgtcagatcgatttcccacaaagtgatcctggcggactgcgccagtttagcggattcgttcagcgtatcctgcgaaatgtcctgcatcactcctcctcagataacaacctgttcaaaagtcgtggtcacagtcacccaaagagagccaacgttaatcgaccatttgcggcaaatcacccgaatttgtgtccaggtataaggcggcgtccagagaaaggatttcactccaccgtggcgggataaaaatgcctcaaggttctgatgttctcccttacgaatccggaccgttacgttatacttcgccagatggttgttcagcccggctggacgccgttgttcatacccgtcacccagttttatggaggtgacttttggttctgattccactgtcatatcagggcggatcttccagttaaatgtttccattgttatcgccctcctccagcaatacccccgtcacgcgactgctgttgccagaaatcaatggcggctttttttccaatgttatatacggcctgtaatgcctgcggaccaatctgtccgttgccggcgtcgttgtggatttcaatgttgtactcaggcgcaaacatcgccatccctcctgaaccggctgccacgacacccagcttaccgtcagcaccacgacgaagtggtaatattgcctccggtcctgcctcgcccatcaccccggcacctttggcaaaagcaaaaaatgtcgggcgattaacaatgctgccgctgtactggctgagtcctgccgaacggtacacgccgccgtccgcattcggaataaccgacagcgccgcagaactgtatgcccctgatggtgtactgccgcctgccgatgtgccaaagccgaacattgccagcactgaacccaacagtttagaagccgcaatacgtgcctccatttttgcaaggtcagccaggatggagaccgtcaggctccggaaactgccctttccggtcacggcaaaattcgcgatactgtccgccatgccgttaaatgcgtttgtgaaaacgttctccgtcatgcctgccacattgccgccctgcgccagaaagttatccagcgcccgcgacgcccccagcgtccagtctccctgcgcagcgtcaactttcgcattgtaatccgcccactcagccagccggcgatcgagactgcccttcagcgcctgctccgcctgacgatattcgtcagaaccgtatgtcccttttgccttgctgtcgcgtttaagctgctccagttgttcctggtagtgctgctgaattttcagacgctcttcgtatcggccacgttgctgatcgcccatacccattgtggccagcgccattgcgtgctgttgcctgacgcgggattcttcgtcagcgagctggctggtcaatgtgagcgtctttttcttcagttcattaagggcattctggtgttgcaaatcctgttgtgagatatccagcttctgtagcgcaagcgcaatttcatccttatgtgccagtacgctttgttcatccgccgtcagttttttaccggacaaatcagcgatgcgctgctgaaatgacaaaagctgcttatgcgcttccgtcattttttcggtcgtggaaagcttcgcggcggtaatctgcccttcagtctgcgcctgttgctggctgtactgcaaaagcagtcgcctggcctcgtcgttgtggtaagtctttggctttttcgcctgttgtgacaacgcctttttatgacgttcattttcgcgctccagtgcggcattgcgtacagcagcatcggcatactgcatggcggtaatgcgcgccacctcccgttggtgccgcagggattcagtttcattatcccggttcagcgcggcgttctgctcgttccgacgtttctgcgtttcctgataattacgctctgcctgcgccttcgcatccagcaggtccttctggcgtttctgttcctgaagttcgttcagctgctgctgatcgtattcagtctgggaagaagacaccgtccagggcgtttttctgtcgcgcgcgattttttcctgcagtgtcgcgatcttttcatcgagcgtgtcttcccgcccgatatccagcatccgatcccatgcccacttcgccgcatcaccgacagcattccatgctctttcaatccagcccagattgtcgtgtacgtcccccatccgcttattcatttcttccgaatacgcggacatggcaattttcgcggcatcagccactcttccctgctcgcccagtaccctgatttgttcaagctgggtggctgtcagaaaatgcagtgtcctgtccagttctttcgccgcattcaccggatcatcccgcaggcgtttaaactggcggatggtttcatccactgattgtcccacgttttcctgcattctggtcgcggtacgggataccattgccattgcctgcccggtaaacgctccgctaccgaccacctgtgccagcacgcctgcagcatcgtgctgcgtgacgccatttccggcgagcgacttcgccatcgcattaagctggcctgtggtttttccggcataactcccggtcagaataagctgtttattgaacgtctcgctttccttagcgccttcatagtaggccttgcccagcccgtaaacagcagcagccacgccgccagccagcccgccgagcatcatgcccttcggagacatcagttgctcgatccacccggcgcggttagcgagcgtgataccacttccccgcagtgccccgaaattcccacgggccagctcaccagccagcacgcccagttcacgacgggcagcagcgcttttcagtcctagcgtatgggtggcagttccggtacgctccagtttacggatataaatatctgcggcgctactgacacccagttcagccgccttcacccgcagcagctcggtacgggagaggccctgtaccgtcgtctgctctttcaggcggcgtataaactgtgcttttttctgcgtggccagcgcttcggcatcggtaagctcacgggtcttcctggcggtttcagacaccagcgccagataatcgccctgtgagatatctccgcgtcctttcgcctgtcgtacctgcgcctggatacgctgcagctcctgcagaccaccgcttaactgttttacactgtcaatctggcggtaaaaagcagcacttgtcctgtcctgtgctgccgccacagccgctgactgcgcctgttcctcacgcagtttccttcccagtgcctccacccgctgtcgcgtctgatccacatccgccgccagacgcgtactggccgctgcgcttttctccacagcggaactgtacgcggtactgctggcagtcacttgctccagactggcggacgtccggcgcgtcgcctccgtctgcttatccagaaaacgctgcatccgggccgctgaacgttctgagtcaccagccgcatcgttcagcaattttttaatgcgcggaacttcgtttcggaactctgcgctgtcgatacttaaatcaatgaccaggttcgctatctggtccatagcggacacctccggtaataccttcgcccaggatcatcagttcatcatccgttttttcgtgcaacgactcaggatcagtgatcaggctgaacatttctgcatcgtgatgcgtgcctgtaaccagtccggaaatcagcgatttcagcgttgcaaactccgcatccagcaacatgtcactgaagctgttcttcccgaaatgctccgcccactcacccagctctgtcgcactcatttccgccagcatctgccgccagtctggtcgccggaactcacgcgcgagccgcatcacaaacgccagctcccggttcaggacttttccggcgtggtcgtgtccttttcactcccgctgtcgtcttcctgcgatgccggaagacgcataccactcagggacagaaccatatcagcgccacgtcccagcgcctcataagaccattccagtctgacggactcatacagggcgcgggcctcctcctcttttttgctttcacacagggagcgggataccagccatgcattaatatccacccccatctgcataaattctgtctgacgctctgcttccgtcagggtttcaggctgtgcgtcatagtctgccgtccgctgctgaataaacttcagataatccacacgttgcagggcagaaagctcactgagcacgatggaatgcccaccgtagttaaaggtgtctgtattgagaaacatgatgattttccatagaagccccggaaccggggcggactgataagagagggttatgacgccgtcactgtcactgctgccaccgcgacaagactgccgtcactgctgataccaacaatattcacgctgcccgccttcacgcctttaaccgtggccacattatccttcagcgtgacggtggcgatcagcggatcggcggtcgcaacctgcagcgttttatctgacgcgttatcaggttttaccgtaaatgtcagcgtggtggtggctccggcagccaccgtggcactggccggcgcaacggtcacgccggatacgctgactacgtcaggtgtatcctcctccgcaagagaaggacgcccgacgccggtgatttttacgctgcgtgtcatcacctctttggacgtcacggttttacccagtgaactcagccagccgcggaacacatcaaccgtcccgttaggatacctgatacggaaggcgcgaacttcgccggtgtcaaacagctcaaccagttttttctgtccggtctcaccgggtttccaggccagcgtggccgtggtgtcaccgacgcttttctgcccctgcgtagtgcttttccagtcggcattttcatcatcaagatagtcatcgtcttccgcatctgcactcatttctccgggctgcagatccttaatacctgccagtcgcagccagtcatcatcagccagtggatttttaaacgcatcgccgctgccggtatacagccagaatgtggttccggcgcctttcgtttttaccagtgggtttggtgttcccatcatatcctcctcagttggtataggtgatccggtaagtaatttctgccatcccccacgttgccatttcgctgtcacgctggtagtcataacccagcggggtcatggtatcgataaggcgctccagaccactaacctcttccagcgcaggaaagattttttcttccatccagatatcaagctctgtatcaggagcctgagccctcagaaaaactgccgtatggagagtagcctgccagtcatcctcatcggtcataaggcctgtatactgtgcgtctgtcagccagacagctattgcgggtaaatcttcctgttctacgaaagcaggaagtccatcaaaaagagtgacaggtgcgccagtcacggattccagcttttccagaacggcccggcggattaatgtgtgtttgctcatcagaatgcctcctttcctccccggcctgaaggccggggaggaaaggaggcggttttccggctaactgtcttttgcataatcacattttcctctttaatatgtgaagccatgaaacgcgcatataaataccggttttaccccacgactgagcaggctgagcttttagctcagacgttcggttgtgtgcgtttcgtctacaactccatcctccgctggcgtaccgatgcgtactacgagcgaaaggaaaagatcggttacctacaggccaacgctcgccttacggcgctgaaaaaggagccagaatttgcctggcttaacgacgtttcctgcgttcccctccagcagtctttgcgccaccaacaaaccgcctttgctaacttcttcgccggacgggctgcatatccggctttcaaaagcaaacggcacaagcaggcggctgagttcactgcgagcgcgtttaaataccgcgacggcaagctgtacatggcaaagaacaaaatccccttagacgtgcgctggagtcgtccgctgccgtccgtgccgtctaccgtcaccatttccaaagatgccgcagggcggtactttgtttcgtgcctttgcgaatttgaacccgcatcactgccgatcacctcttcaatggtcggcattgatgttggtttaaaagatttgttcgtcaccgataccggattcaggtccggcaatccccgccataccgctaaatacgcggctcgcctggcactactccagcgccggttaagcaaaaaggccaaaggctcaaagaaccgcgccaaagcccacttaaaggtagcccgactccacgcgaaaattgctgattgccgactggatgccctgcacaaggccacccgcaaactgattaacgataaccaagttgtatgcgtcgaatccctgaaagtgaggaacatgatccgcaacccgtcgctatccaaagcaatagcagacgcgagctggggcgaacttgtgcgccagctccggtacaaaggcgaatgggcggggcggtcagtggtagccattgaccagtttttcccgtcctcaaaacgctgtagctgttgcggtttcatcatgaaaaaaatgcctcttgatgttcgtaaatggcagtgccctgagtgcggaactgaccacgaccgggacgttaacgcggcacgtaatatcaaagctgccgggctggcagtgttagcccacggagagcctgtaaatcctgaatcgctcaaagcggcttagattcggctcgttgaagtgggaatccccgtccttcagggcggggagcagtcaacgtgaaagataaagcctcagttgttgtttcagggcataccccagttgcttcggtatttcctcgtcaatcaagctttgtgtggcgctttcgaatgcctgagtcaatggtccggaaagaggaattttcactacatcgattggataacggtttttcccgttaacgcgtcgcataacatgccagcgtccgttagccagttgctgaataaaggcatcccggaacagatatggcccgattttaagcacacttccgcgatacagcagtttgcccctccgtttgctcatcctgacctgtgcagcgcccaactttatggcgggaaggtttccccggttaatccgtatccgggcagagcgtttaccgtctgtaccggctttaaataacctcaccctctggcgaaccagcttcagcggaagtcctcttacctggttatctccggcgacagtctcccgcgccaccttacgggttgccactgaaacagctttctgcgccacgcgattcacagcccagatactggcccggggaaccatctgtcggtcaaggctgttcagattccggatcgcattttcaagccctttcatcagaatgcctccgggaaaccccggcctttaggccggggagcagtcaaacattcctcccgtcctgcgccggttatccgtcggcggcgtccccctgcccagcagaataatactgctgtctccaccagccggagtgatgcgatccacccagaaggtgtcaccgagaatggttagtgtgtccgggcgcttcagatggactgtcagggatgttttgacaaaaaatgtaggcttgtctccctcaatccggacacctccggcggcatacgacacactttcaggatcgtcaaatacgcccgtaagcgtggcccctgccagaacgccggaggttattgttgctaccgttcccatcacccggaggatggcatcatcagcctgagaaatcgcggtatcaaacaggttttcggactgcgacatatcgccacccttacagttcaataataagtcctgcagcaatcagctcgtccacatcgtgttgcgaaatacgcgccgggtttcccgccataaccatatccagttcccggttactgtccggatcgatggcgcagatgtgtagtgtacgaagcgccctgataagtacccgttcggatctttgcccgatcccgggcggcactatggattcatcactgtcattttccacagcaggcaaatgctccgcctccgcttcctcttcccattccatgacacgctggctgagttcagcggcgctcccggacacatccggatcacgaccaagccgcgtcgcaagctcccgcagacgctgtatattctcttcttttgttgccataaaagatcctcccgcaatttgtaacaataaaggcctgaatcaggccttttgggatgcttaaccgacagtgacaatgacaaactcatccgggtccggcaggaccatcagcggcgcagactgcgtcatggtatattcattcgccggatcccccaccgtcagccagtgtttgggataacgggtggcggcaacaataccctccgcgagcgcctgtgaatcctgaatggcaccatagcagcggataccttctgccgccgtatttcccagaaccagagtcccttcaggcaggtaacgcttttcggtcccgttatcagcaacataggatgttttagccaccacaatggccaaatctccgtaataccccttgaacgacaccacagccccaaggtccttcaccgccgtttccagctgagaatttgaaccgcggcgtgtatccagtttttcacggaacagcttaaaaccgttcagcagacgccagactttcccgtccatcacggcaatattgatcagaccggatgcctggtcgcagtacatatccagatcataagtcgggtcaaaggtttccctgtcctgctctgaccattttttacctgtggcctgaataatgttattcccggcggagcgaccaaaatccacctccacggtgtcaaactgctcgccctgcatggtgtatttcccgttcagcaccgcactgacggcctgcatctcctccacctggacgatggccttctcttcctgcttcaggttatcggtcagaatgcgcagacgacggtaggccggatcgttaagcctggccgggtcttcacccggcagacgctcaacaacctgcgcatagttaacttcatgcttcggtttgacataccccggacgcagtacgcgcgtttccccgccgcggttacgcagaaccttccctccaaccaccggagatacataagcggcaatcggtgtttttccggtaattttgtccagcatgacttcctgggtaggaaatgtcacagtacggcgaaaaaacaggctcaggaagagtgggttaaatttaactttctgctcggtataacccagcaactggcgggtggtaaacaatcccataaatggtgtcctccggacgttaaatacgataaaggccgcttcgcggccttcttattacggtaaagcggcgtgactgacggcgcttccggcgaatgcatttgcctgcttaatggcatccacactcttcggccatgccagtgattctgtggcaaaggtgccgctcttccagtacgtcagcaggttttccgacccgtccagctcaagggccagaaccccgaccgccgttccggccttctgcccgtcccaggccaccagtttcccggtggtatcatccagcatcaggggcgtcagcatcggtgtggccgccgttatcccgctgactcccgttgcggtatgtgccggatcgttaccggcgaaaatgcggttatccgcacgtttctcaatagtggtggtaaatgacatactgtctccttatcaggtggctgaagtaccgggaatactcatcaacaacgtcgtttcggtatcattactgtggcctttgccgccggatatggggcccggggaatgagactgcatgaaagcatcaaatgcgttgttcatgctcagccccgcattaccggatttgtccggcgcggcagccagcaggtcacgggcctgatctgtggtcataccaggcatgacagccagtttttccgccaactcttcacggcctttcgcctcatcaagcgccatcacggcatcatgaagtgacgttgccgcagcgatcggcgatgctgccagaatggttctggcctgttccaccgtcatctctggcatggccgccagtgtctgtgcgagtgtttcccgaccaccagcttcttccagggcaaggatacggtcagcggtgctggtcgtgtccgccggcgcggcggcagccagaatagacttcgcctgagcaacgctcattcccggctgcccggccagcatctgtgccagtgcctcatgccccctggcctccgggcaacccagaattcccattacgcgctggttttcctgcgtgacagcgtcagctgcacttaattcaggcatagtgcctcctgtcttgttactgttgatagcttctgccatcacgccgatggcgtcagcagcattcaccattccatctgccagtccggtagtgataatggcctgcccgtcatacactgccgcctccgtcgccattaccgcatcgacagacaaccccgtgtaccgggccactttttctgcaaacatctttctggcctcgtccattcgctgctggtagtcggcatagacactttccggtaatttctggctgggcgtcagatcagccttgtgtgcgccagaatagataagggtgatatcgatcccttcctgtttcagtttttcggcgtagctggtatgcgccatcaccacaccaattgatcccattctggacgtctgggtcacaaggcggtgcgaacaggctgccgccagcaacatggccgccgaacaggctgtttcatttgccagtgcccagacaggtttctgttcgcgcatccggtaaatcatgtcagcacagtcaaacgccccggcagcctgaccgccgggactgtcaatatccagcagaatgccttttacctccggatctgaaaccgcctgttgtagccgggcagtgacaccgtcatatccggtcatccctgaaaagggacgcattccgccgagtttatgaaccagtgttccggtcacgggtaataccgcaataccgttcactacctgataaaaacgtgcctgcggctttccggtcgccataaaatcgcctgtgaccagtgccatatccgactgatccagactttcgttattaccgggaatgtgcaggctgttaatgcctgactccctgcccagcgcgcaaaagaaaacccgcgcataggcgggttcaagcagcaacggagcactggttgcctggctgatgatgtgcgagagattacgttgcacgcttttcctcctccgtctgacggctcgccgcgatctgttgttgataggtatcagtgatccataccggacgcgaaagtccggctgcccgccgttcttcggattccctgacctgctggcggaatatctcctggtaatcctcgcccataatggcgagttctttttcataggtactcagcccggcctcaatacgcatcacggattcctgaacctccttgagtccgtcaatcgccatacgtccggcaccaatccactccgagcggctccagctggatcgggcctcccagaaggaaaacctggcccggggtgcccggataactccccgtatcagcgcctcctccagccagcaggaaaacatttgtgtcgccagccgtccggcaatgaaccggcgccgccccaggaaatagcgccaggactcattggcagatgcgcgggcgctggaatagctgacctgagaataatcacgcgaaagctgctcataagagacccccagcccggcggcaatataccggagcagcgcctgctccagcgctgaaaagccattatcggaatcctgcgcagtctgcagattcagctcatcacccgggtacaggtggggaatttttacaccgcccagtttgatactgttggtactgtaatagcgggcataatttgccagcatgttaacaaggggcgtatctttgttatctgccgccgtgatgtattcaaaggctttctcggaatcgagttcgctttcgatcgtggcggcgtacatggctttgacaatcgcggactgaagctgcgttgcctgcagggtatcaagcatcttcagccgctccatcacactgtaaaactgattggcaccgcgcgtctgtccgtcctcaaccggctcgaaaatatgtaacatcgcgggtcgtccggacggcagaaaacgaggaatacgggtccagcgttccccaccagccaccggccagtcatcatcacagacatgataggcgagggcttttccattccggtccgtttccactcctgcgcgaagctggcggtttccgcgggcataccccggcgtgtccacccgtttcggactgacagccttgaatcgggtacggaaaacctgcgtggtttcagcgtcccagacaggctggagaaaaatttcaccattaaaggcgtgaacgcccacgccttcacggatgaactctgtaaaagtacgcttcccctcggcatccatttcgccaaaaataccatcgcaatattctgtccatgcagcttcaacctcatccacaaaactcttcgctgcgctctcacgcataccaagatagcgccagtttggacgatagctgataagaaacaggtgtccgacaatatgatccttgtgcagcgccaccgcatttgctgcaataccattattacggaccagatcatcagcccgcgcattgccgaggcgcaacgaaggcagcagcgcggcatccacgctttccgccgggggcatccagtcagccatctgtccgccgaaaccgatccccccgccggtgtatcccagactttcccgcagcggcgtgccgtgaacatccaccagaaccggggtgcgcttcacagtctcacccccacaggtgcccggcggcgaccattgcacagtgacgcctcaagttccgcgacatattttttcagatcccctaccgatgtcgcggtaaattcaacccgtcgcccgtctttctgaaccgtcgccacccgttttcccgtcatcaggtcatgcagcgcgacgcgggcttcctgtagctcagtgattgttgccattaactcctcctgccagcattgcggccagttgttcaagtgtcggggtatcctgctcttcgcttttccttgatgtcgccagcgcctccagatccagttgccagcgctgcacagacacccgtaacgctgcactggcatagacaagacaatccagcgcttcgttacgacgtcctttggcatcccataacagccggaattttccgttaaccagtttctccaccagctcttcggctaccagttgcttcgcttccacctccgtaaaaacatccggattatccggaaagcggatcgcataaggcgtggcttcgtcggcaggcgcagtaaccgcccccattctggcgtaaagcatttctttggcagtatcagtaccgatttcgcacaggaataccccgctctggttgcgttttttaggcatggtaataacgggttttccgtaaacggaggcccctttgacaggcagcacgcggaaaatgccgtgtttttttgagcgtttatagacgatttctgcatcgataccgccgatatcccagcagatacgggaaatggaaatatccgtcccgtcagcatgacgatattttttattaatgacggcatccacacgctgcagggtatcttcatcatcatgccgtcccatgataatttgcttatcaataaggaaagcctcttcgcccggcgcccagccccagacatacatttcataacggttacgctgggagtcgataccagcggtcagatacaccacccgctccggaaccggcgccgcataatgaatcactttttccagcaaaagctcatggctgagtttttcggccaccgcctcttcataaggctcgcccaacgtggtgtttataaaggttttcacaccatttggatctttcagcgcatccagccagtcataaataatctgtatccaggtggtaaagggactgtaagccgtccagatatgaaaggtaatggatcgtggcggcggaacctcctcaccggacgcgctgaaataagccagtccatcgcgtgtccacatgcctgtgttatcgcaaatccagcggcctgctttctgatcaagttccgattgacggatcacgcatccattatgttcacaaaggtaatacaccgtctccggcttgcttttctcccatttcagaccgaacggcgtactgccatcaccgaatttaaggtactgttcttcgccacaatgcggacacggtacataaaaacgcataaaatgcgccgattcatttgccgccttttcaatctggcatgaccctttgacttttggtgtggagccccgaatggatttaggccagacagaaccttcaatacgtttatcccccagcagcgtcggcgaaccttctttctcgacatccggctcaaaagatgacaattcgtcatagcagaccacatccaccgatttttcacggtagtttttggctgctgcaccgccgaggcaccagaacccgacaccggaagaaaagcgtttcagggtaagcgtgttatcacgatgtttacgcccgaaccagggggccagctccagcaatacaggaacatccctgatagtcggctccacgtgggatttcataaaatcctcagcggatgagtcggtcggctggaacagcaggctgttgcgcgacttgtgctctatgaaatagccttccacccccagcaacattttggtatagcccacgcgggcagacttaatgaggtttacaacgcggatcagttcataccccatcgcgttcattatcgctacctgaaacggcagcgtttcccatttgccgggggtgtaggaggactcttttggcagatagtaatactcatcagcccactgcacggtggtaagcggtacgggaatatgaagcgctatcagcccgttagttatggctctgttggcattattcgccctgcgctctccggaaatcatcggtccacttctccacatccgctatcgtggcggccctgcctgacgccctggcgatttccgttctgaccacatcgatgtgcgactggcacagatcaggatatttgcgctgtaataccagcggtacccttgacagtatccctgctatttcctgagccacccgttgcaggatgtaggtgaacagttcggtctcaagaaccagcccttcgcgctcagcatttttaagttcctgcgcatccgcctgggcttttgtcaggcggtagcgctcatagtcgatggtgccgggattaagatctgattccgcagcggcacgtaaatcatcaacctctttacgcagcttttcattttcaatagacgcatcacgctccgcgtaccatgaaatcgctgccgcggtgtcgaacactgcttcgttaccttttcctcctccggaaacaagtggcagcccctggctttgccaggctgtgacagttctgacgtcacaaccaaaaatttcagccagtttttttttattcacgttcatggaaaagtctcccggaaacaggaaaggatctgcgatcttcgtttttaactaaaaacgttatccagcagatcctttctttttttctaaaaaaacctttaaaaacaggaaataaacaataagaagaacggatctggcttttctctgaaaattttcataaggagtgaaatcctgcgacgctgccgccccgtaacaggcagaattcccggaaaggaccctggaaaaaaccgaacagttattgttacaatataacaattaatcattttaacgctgactgagggtcttacatatgaaattcaagagtattgctaaaactgtttttctttttgcactgctaacctcagctggctttgcaactggtaaaaacgtgaatgtcgaattcgataaaggacaaaatagcgcccgctattccggcgtaataaagggatacgattacgatacatataacttccaggccagaaaggggcagaaagtacatgtaagtatttcgaatgaaggcgcagatacctacctgttcgggccaggaattagcgattccgttgacctgtccagatattcatctgaactggatggcaatggccagtacacgctaccggcgtccggaaaatacgaactgaaagtacttcagacacgtaatgaagctcgtaaaaacaaagcgaaaaaatacagcgtcaatattcagataaaataaatgccagcctggtcagggggttcgttccaacaccaaacttttcagccactgggttatttcatgaggtgtaccagtttttagcgtctggttacgtttttgaggtgtacgaaaactggcttatatcagtacgataaaaacgcgatgtggtagtacgcagacccagagacattgtcatgtttatgcatttctgaaactcccccgcaggtaagctccttttccctcctgcgggaattttttatttgcactgcgtccggatgtactcctgcaaatacttcagtttttcctgatcgctgatgattccggcgcggatatcgagaacgttttgtccagcaactggagagagttcgacggtggcagcattgcccacgcggcgggtactggcggttttggttgtggttgtggttggcactgtacagcgtccttcgacacgcacccggctaccagcagcaaggcggcgctgcaaatcagtattcctgttttgtgcatcagctagttcctttgtgtattttgcatcgagggcggcaacgtcacgctggcgcttcgtcatatcggtaattgtctcgttcgccagcttcaggttgtgagtagcagtatcacgctggtacttgtaagtgatagcgttattgcggtagtgatttgccagccgaccggcaacaattagcgagacgagcaacaggccaacaaacatcgttttccagttgaacatcatgacaggaacagagcacgctccgcctcacgccgacgggtaagcccgttcagtaccttgctaccagccttattccagcgcaggaactcatcagcggcgccagcgtaatcaccagcgtttagcttccgcagcagagttgatgtggataatgtccgggcgccgaggttgtacgcgaacgacaccagcgcatcaaactggccttgcgtcaacttgaccttaaccagtctggacacatcattttcataaccgactaaaccagttttaagcaagcgctcggcagtagcctcgtcaatcatcattccgggcttaactggcttaccgtcaacagagtgggtccagccataaccaatcgtccagggatctccccccgttcccgggtccggataagctttcaggctacaaccttcaaactctttgattagggtaatgcctttttcactgattctcatcattaacccctgcacgttttttgagtgcgctaattgcgatttcgcgcagcttgtccacaccgacaaagccaataattccgccaacgaaaggcgaaatggaaaccggcaggcctaccacatcaagcgcactggtgacacataaggaaagagcgccacacaggacgccctcaagccatttatttttacgggtggcgccgtcgtatatcagtcggccgtaggcaatgagtccggccattaacgccccaagtatctggggccacgcatttttgagtccggtcaaaaccgcagcccagaattcaggagtcttgtcattcattttcataagcctcacctccgatgatttcggatggtaactagagtgagtgaaatggttgggttgcagggtttaatatcttgtaaaacaggattgcctgtggttgcagaatctgaaagtaaaatcacgcagagtacaattttaatggaggtgaggcacaaatactgcaaatttagcttttagcttaattgattgcgtgctgagtgaattctgtttgacaaaaacatgctatttatagaatgttaattccatgtaataaaaaggatgtgtaactcatcatgccagcaggaattaaaccaatatttatcaataatatgatgtcaatatatggattatccaatcctcatgacagcaaggtatttccagaccttccagaacaccaagataatccttcgcaattacgcctccaacatgatggtcttgctaccgatgataaagccaggctggaaccaatgtgtcttgctgaataccttatctctggaccaggaggaatggaccctgatatcgaaattgatgatgatacctatgatgaatgccgtgaggtactatcacgcatacttgaagatgcatacactcaaagcgggacattccgcagactgatgaattatgcctacgaccaggaattgcatgatgtagaacaacgctggttgctgggagccggagaaaactttggtactaccgtaactgatgaagacctggagagttcagaaggcagaaaagtgattgccctcaacctggatgatacagacgatgattcaataccagagtgttatgaaagtaatgatggcccacaaccatttgatacaacacgctcatttattcatgaagtagtacacgcgttgactcaccttcaggacaaagaagataacaatccaagaggcccggtagtcgagtataccaatatcattttaaaagagatgggtcacacatcaccaccaagaatcgcctacgaatctagtaattgacactcatcaaaaaatgcaaaatcccacgatgctacaacacagtaaccagttcaggtcagcagtccatagacactggctcctgtcaggatgccacctgctaacccagtaccggaaatcggatcggacattcatccccctctggttgtgtgggtcctctcagttatgaggggaaataaaaaaggccgccgaatggcagcctcaaatggaatatgtattaaattggaggttctaacggtcccgccagaatctcagcctctccgttgtgacaaatgtcatcgccctgcgtcagatgccagacaccaataatagtctgaccagtttccaggtcctcggttacgccgtgggtgtagtaagcaacctgaaccctgccgttgtgctgtatccagtagaagccttctttcattctaatctctcctcttcttaagaggagtttagctattgggattgcaggttggcgttagaaatactaaatcatcaatgaagtatttctctggtccgccatcgaggattcgaaccccgaaccacagaggtagaagctccgtgctctttccagttgagctaatggcggaaaaaattgaccagtgaagtccactggtcatgggtcatgcagttgtctctgcgaaacgggtgtatccccacccagtgttttcagtatcgagagcattatcaaatgccatattaactatagcatcgcagaaaaaagtcatactgataattcccaatgacgcacttctgaaaggctctatggttgtattgcgttgtacatagcgcaaaaaataccgattggcagacttagaaatggaaaaccccgcacgatggcgaggcttgaatttgtttggtcgacgattgaagctatggcgacgatatcagatttacataaaatatagccgttttaatccagttttgcaatcaccacgtcgccagcttctcagcaagcaaatcccttttaatgactatccagccgctatcgcgtaatccgctcaatatctgctctacttttccaacgaacatgtctagaccaacctgccgaatgtctttgacgttaccatcgcggatcttaatcagaaggtcgatgttaagcatgtcgacggcaggctgaacctggcgtgttggcgatggtagtgtctgactgaaatagcaatcctccagtttttcgaacacctcccaagcctgatctgtttcgagcatcttggcgtggcgggcagcgccgcgttctgtccagaggattagggaacgggcatttttaccaactaacccgattgtttcgggtctgttcttgaactcgcgtaattcgtttttttcaattttaaaaaaatgctttcctacaacgaatcgcgtggtgttgttcagaaagttatcagaaatgtttttgatttttgtgccgtataagtgcgccaaaagttcggtagtaataacgggaatttggttatgggtaatcggggaaagagtttcgacagagatttgagtggtcataatgacgccctccggtgattgttttgtttatcaccaccgccgacgccaatcggattgggtggtgagacgtacagggttggcgtaaccagatcaccgaccggcgagcctttcggctcccccatacgccccaccataattcaaatgcgcgtatacaaacgacaataaaaaacacgctcgcggcgtgtctctgtcgcggtgaaattccgggacgccaatcccgacgccagattttgctggcgtactgggaatatagccccggataactgtttgtgtcaattaagtgcgtataggttgaaagccacctgttccgaacgcgactccgatacactcaaaagagacgcctgatcaagacgcagaaatatcgcgcgcatggtcagccagtgtctggtgaaggtttctgaccagttcttttcgctaacgcctaccagtcccgctaactctttatattgataaacctcacgcccggctaattcagatttgacatcctgtgccgccagccagattaatgcccggagtcgttcctgtgttttaccggccatcttctttccgtcgagttgcgccgcaaacgcactccagccccactgtgttatttcgacctggtgttcccagcaggtattctcactgtaattccacaacaaccacgccttgtagtgttcatcgagtgaaagaaccgcccggcgccatgaggcagtggaatattccacaggcttcaccagcgggatagcgcttcctttcgccagcgactgcttgccggggattggcgggttatttaacgttatccagctttctgtttcctcgtcccagatacgctgtttttttcggggatagtttttcgtgtcgaattgcgcgttctccagccaggccaaaagctgccctttagtctccccgcttaaatcggctgtcgctaccattagctgctcacgtacatactggaggtattgagtgttcattgagtaaatcctgtgaactgataaatacgaacaaaattgcgcaggatgcggtagtcaaccaacaccgaccccggacggcggtatatgcggaggcgctgccagcgcatgcggagtatctcgatcagttctggtttcatgcggcctccagcttttttagcgcacgcagatccgccagagccgcgagcctgatttccttcagctcctcgaccgtccagcggtgcggggtgttattgttctcgagtgccagcaccgccgcctcaccgtaacgctcaaccagcgcggcacgatatgcttcgatgttccctgatttgtagacgttgtagacatcacactgaagatggatgttgaagcgagtgaagcgcagatgcccggcggcggccgtactcctgtaatggcctgcatgccatgcgaatgccgtcttcgttccacaggagatgcaaccgagtccttctgccagttcggtttcgcggcaaatgtcatttacggcgcgctgcgtcaagtcaatccagtgtttcagcggcttaaccgcggctttccgctggcgccaggcggcgcgttcttttttctcagcggcgcgctgaagggattgcgccttacgttgcgcggcttcgcgagcttttctggtttgttctttgccgacggcgctggcacactggtacgagcaaacgatctgcccctcgcgtatcgggtgaaaccactggcggcattctttgtttgcgcacttacggcgcggtaatttagccatgctcacccccagaccttttggcgtaaggattttggcgtccgcacccggtgtgcatattcaggtaatttcgcgctgacagtccaggtaatgaagtcagggttcaggctctttcctgtccttatgccccgcttctgataatccgatatcagcgtgtcggcctgctcggttgtgcagtcatgatgatggaaccaggagtatttcatcgccatcaccccgcccagctcatgagctgggcggcggcgttctcggcctcgcgctgagtacggaatgtacgtgataaaatccagcgccagagaacatcaagcgcggatttatacaactgctgaaattcgacctcatccatgctggaaaaagcgatgctgcggggatgtttgcgaagggtgccgtccggtaactggatggcgtcatagtgaccagcctcaaccgtcacccatgcgcggtaggcatcgaatgatttacacaggctaatcccgtttgttacccggcggtttgcaatctgttccagatactgttcagccgcatccagtaatgcgctttcattcccgccatatgcagcgagaaactttgcataaccgtttaccagtttgcgctcattggcagaaatggcgccgccggtaggttcccagtattcaaacccaagattaagcaacgcgaaaaagcggcgatggaatgcaggattcctcacctgacggaactcagccaccagcacggcgccgagtttaatttttgactgcagaatttcgctggtctccggcgtagcggggatcagaattccagatgactgcttgatgagttgtaattcgtgcgccatggtattctccgtggcgcataattgtcaggttactggttgttcaggccagtgcgataattatgattgcgtgcttattgttaagtcaattattagagcccatctctctgacaacttccataatggtatccttagaccagtacaaatcatctcttgatagctttcggtttgttacagaaccgttttgggttgataggatatagcgatcacctgatgcaagtctaaaagacaaaagttctattcccttagcatcagttatagtcacccgcaaattatcagcaagatctgataggactccctctgccacgtaacccccctgagcgacacacggacgcggttaaaaattgtcggcagcagcatcaaagggatacgcaaattgcgatattctgaaaaatgcgcgccagcattaagcgcaatgttaataaaaccagtcgtcagcgctttcccacgtttcctgcagaatgctctgtatacgttttttatcgccatcagcagcaccgacgatactcagaccatcctgactgcctcgacggatggttaagttgcagttttcatactgattctggagacgggtaattaattctttttcaagcgcaggaacggcaccttccggaagctgttttgcccggctgataacaagttcaattctcataattccctctacattcaaccactgtatataaacacagtatacctgttagaaagaatattcaaggggtgaatagcactttttgcaaaggctagtgtgttgtttcatatcacattttaggcaaaaaacccgccgcagcgggttcagataaaagaaaacccgtactcggcgggttcacattcattcaaattacgcttacttcttggtgttctgctccgacatttccatatatcgccatgctaactttgtctcgatcttcctgtgattttgctgcaatgttgaaaacagatttatctaatcgcttatagtcttagacatttcgaatttttcaccgattggctttagctcatcaatagccttatagatttcgtcatttgatggttttttaccagaataagcatagttgtaagcataaaaaacatctcctctggtatccttgagctccataacaggaaccttttgaacttttccattgttattacttattgggataaacttggagtcatgttggcttgaatacaaccttggctcttttccttcttcaaaaatcattcgctgatacatgagcttatcctcgtaattcatcaaataattaacaacaaaaagttagtgtgattgtacctaataatgcttttgctttctgctgtggatttaaccagctatcattcctcctgctgaggtgctgccgcaactcgcaaagcatcttcaagatttgtgacgtattcagagatggccacctcatcctctccaaactcatagagcacgtcaagcagcgccagcacggtggcggggttagcggcggcaataaattccgcgtcacgtttctcaacagtatgggccaacgtcacttcttcaccgcaaagagaaaatggcgttaccgtgatgccattgaacagtgatgaggtgcggcgccaattccccggcgtagccctctcagccacttcacgaagcgcccgtttgtcgatgttgctcattgggctccccccttgttgatgctcattttggatgctccataaacctgcattaccgggcttttctccagcaccggcagcgctgaaaatcccgttacctgactactgctgtatcgcctgaggtcataatcaatcaccgcacgctggtctcggaaaatgccgcagcggccatgacgaatgaagccgcctcgctccagcgcgatacgcagatatttctccgccgtggttcggtgcacgccaaaaatcgcaacgacgtcgttcgtcgtgatgcgcccctgctctttcaccagaccgataatccgctcaagaataatcatccgttcgctttgtgttttaggtcgggccatttttaaccccttatttcacaatccggaggtggctaacgtttttccggtagctttcccagtcaaaattcacccacatccctccgtccatctggaggcgatcgataaccctcgcgcccagtgaatccaacagcccctcgtggttaagattcgtcagaacgccaacaggtcgcatcgatgagagacggcgatcgataacctgattgagaatgaccttctcaccactgcttccgcgctgaataccgacttcatccagtaccagcaggtcaactttacaaaggtcatcaagcagggacgcttctgattgcccaccgtcgtagcactcacgaaccctgagcatcaggtcaggaatagttaccaccagaacgctatgaccgccggccagcagatgatttccgattgccgccgcaagatggtttttcccggttcccggaccaccgctgaacacaaagctcgcaaatccactaccgaagttctgggcataactttttgccatcgtgtacgcttttcgctgcccctccccgcttacttcgtagttagcaaacgtacagctacgatggagatcctgaatgccagatcgcccgaaaatcttctcggtgcgggatttctgattcatcctgtcaagctcttcactgcgtttacgcccttcggcttcctgccatgcccgccactcatcagcagtcgagaatttcggctgcacactggctgggataattcttttcaggcgatcaagcgcactgccagtaccgattacgtttttcatcgttaccccctgaatccggtaggaatggttttgtctggcgcagaaatgtggttcacatctctgccagctcttcggtcgttgagagcgaacttcggtttgaatagtccctggtagccgttggcaatgcttgtgttgatgacgtttaccggatcgtggccttcatccaggcactccttcagaagcctgaaagcttttgttaccgtcagttcggtttttatgggctttccggattgctggcggtatgtgacccattcgttccacgacgcagcattcagccattcgggaacaggaatactcaacggatcaaacttcacttttcccttagggggattaaagggggttagatcttttatatttgtctttggaataatgtctttggtgttccctgttttcggggatgcccttccctcttttcggggataactatccccgttttcagggatggctgaatggggtaaaacgctatccctgttttcagggataactatccccgttttcggggatgcccttcccccttttcggggataactatccctggtttcaggtacagaaataatccatgtggcaatttcatcatcaggaaaagacaccggacattttgagcaatgtggcttggaataagcccatttatccaggtttgtattaatccctatgtatcttgtttgaccaatacggcgcaggataatgatgttacgataggcaagactcagcaccgcttcggatacatgctttaccttcagtgttgtcttatctgcaatgaggctgttggcaatacgatctgattttttcgaccagccataagtcagccggataatcgcattcaaaacacggaactcacgccccgatagttcaacgatacacaaggcgtcctggatctgattagctaaacgtaaatagccattttccagatcagccatacggcactcctgttgcgtcggtatcggcgcagggaatttgtatatttcagcggtatttgacatactcatctccgcaattacctaccgtttttgcaccagaaagccgttggtgacccctcaccgcggctttcgcctttttagttgctgccattttcagtcccaccccagcgcatccggcctggctcgttcagcctttagcccggcatcagcgagaatctctactgctgtgagatagtttctggataccagtaccgcttccggtggcgcggcctgaatcccaagaaaagccagctctttcgccatgttgcagaaatatccctcagctttacgcctgctgactgtcgactcgctgatgcccatatgctcggcgtatgatttctgccctactgatgcaagccggttgagcaggacgctctctatctcaatcgggttgatttctggtgggtctaactttcgtgcaattgcgttctccatgggtaaatatcctctatggttatttggctgatgcctcttggcttggtaagccatcggttgggtttgggtatgctgctgggtcaatctcgtgaggagtgactttccattcaagaatttcacataacggcaggatgcgacggggaggaattactccttttctcagccacttgcctacagcttgagacgagataccaaaatgttcgccgatgctcatttgagtcatgtggttactgattttgatttttaattggttgtccatttggctctccagttctacgagttggtagctggagattatcacgtaaaactttaggttccaacaaaaatcaatctaatagttccaatgaataaagaaactgaaggttgtaaaatgtgaatatgaacaaaaatcttcatcccattttcgccaagcgtatccagcaagttctggatgagaacggctggtctatggctgacctctcacggcgcgtaatgctttctcacacatctgtgagaaagtgggcctctggcacgtctgtagccagcggagagcgcttgaaaaggttatcggcggtgaccggaaggcctgaatattggttcttcatggagccaggggatgaaagtgaaggcgaaagggctgaacctaaacccagagtccttgatgaaaaagaagaaacattgctttctcttttcaatcaactcccggaagcagagaaactgcgtgttatcctccatacaaaagcagtcctccaagagatggatctgctgaagaacaacgtttttgatctaattaacgacctcaaaaaatagaaccaaagaactcatccatacaggtagcacctctttaggtgctatttttatgctccaagatagaacttttagttgcactttttgctttacaaatcgaacctttggttttatcgttagtttcatcgacaacaagcgcatcgttgtcaggtgtaaaacgttccgctggccggcgataaggcaaacgagggtgagaatgattgatttcgcacgtaaaccagctcgacagcaggccgtcccgctcaaccggattgaggttttaatccgccgcctctgctacctgctggcgcagaaaggagatccggatgcttaaacaatgcggttactgccgcaaatccattgatgaaggcaaagaagtaaaaaacacccttctctatctcaacggctcgcaactggcgcgcaaagaaaaggaatattgttccaggcagtgcgctgaatacgaccagatggcgcacgaaagttaaatagtagttccgaaatatgaaatgaaaaattcgccattaatttggcgtggcttcctacaccctgaatttaagactggagaaattatggaaatcgtaaaaatcgaaatgaacctgaaagcagttaataagagcattgctttattcaattgcgaaaagaaagtctcaggcgttattcactcaaattcaactggcgaaaccactgtgattctcgacggtggatatgtactcggaaagttcgactgtcctcattgtgctgtaaaagccatttcgctgctcacagtcaaggtaagtgatggagaacaagcagggtttggtaattaccgaagttacaagcttgattactcagaaaaattttatcagaccatccattaagaaaacgcccaccgaagcgggcgtgccctgtccggtccaaccgaccaaagcgaaccggacctaacaaccagatatatcggggtgctgttaaggcacctccattctacacgaattgaggacaaaacaatgagtggaactaatcctgtatttttagtccgcaaagcaaagaaatcatcaggccagaaagacgctgtactctggtgcagtgatgattttgaagcggcaaatgcaacactggattatcttctgattaaatccggtgcgaagctgaaagattatttcaaagctgtcgctactaatttccctgtcgttaacgagctgccgccggaaggcgaactgagcctcactttctgcgattactatcaactcgctaaagacaatatgacctggacgcaaatccccggcgtcaccctgccatcatctgaagccgccgccgcggcgcgccagcatatcgtcgatggtgttgataccgaaacaggcgaagtgctggaagaccacaccgaaaattttggtaacgaaagcaacagccctgcccaggcaacagccccagcccccgagctgactgttgtcgcaactatgcctctccgtcaccgcgttcttgctcagtacataggtgaaggtgagtatctttatcacgtcgacgcctcccagaaaaaagaaattctgcgtctcgaaatggacaccgataattcatatgtccagaacctgctgcttgccgccgagaatgttgaagcgttcaagaaagccattgaacatgacattcacaaaatagtgaatgccgttaaaaaagtattccctgtcgatggaaaaactcctgaactggcgactgttatccagttccttaaaacatggttcgagacggagcatatcgatcgcggtttgctcgttaaggagtgggcgaaaggcaaccgtgtatcggctattcaacgcactgaaagcggcgccaacgctggcggtggcaataagactgaccgtaaccctgattacgaacacactctcgatactctggacgtagagattgcaatggccactttgcctatggactttaatatctatgagctacctggcagcgtttaccgtcgcgcaaaagaaatcgtaaagaaaaaggaaagtccgttcaaagaatggtccgcagcacttcgcgcaacgcccggtatcctggattattcccgcgccgctattttcgcgctgatccgaagcgcacaccctgagttttatcactaccccggacgccttcaggggtatatcaacgccaacttaacggagactgatcacgagaaccccaccgaggaagctctcacggctgcccgacacactccggaaaaagacgcggtagaagaagccaaccgacagcttgccgccgcgcgcggtgaatatgtggaaggcatcagcgacccgaacgacccaaaatgggtgaaaaccgggacaagccagccgaccaccgaacctgaactggttaaaaatgttggcaacggtattttcgacgtgtccgctttaatgcagaactcatcaactcatggcacagaaacgaatccggagaccaccagcaatgtgcaggttcaaaaagctgacagtgatgaaaaacaggctggtgatgcggtgcaggcaggcgaagacgatctgggtactggtaaagaagcagttaccgtagagaaccagaatcaggctgaggcgcaacaaaacgtaccggaatcgcaacaagaagagccagaagcagcctggccggaatacttcgagccgggccgctatgaaggtgtaccaaacgaagtttaccacgccgccaatgggatcagctcaactcaggtgaaagatgctcgcgtgtcgctgatgtactttaacgcgcgtcacgtagagaaaactatcgtcaaagagcgctctccagtgcttgatatgggcaacctggtacatgttctggctctacagccggaaaacctcgaagcggagttcagcgtagagccggagatccctgagggtgctttcaccaccaccgccaccctgcgcgagttcatcgacgcgcacaacgccagcctgccagcgctgctgagtgctgacgatatcaaagcgctgctggaagagtacaacgccaccctgccgtcgcagatgccgcttggagcttcggtagatgaaacctatgcatcgtatgagcagcttcccgaagaattccagcgcattgaaaacggcaccaaacatacagccacggcgatgaaagcctgcatcaaagagtacaacgtcaccctgcccgcgccggttaaaaccagcggcagccgtgacgcgctgctggagcaactggcaataatcaaccctgacctggtcgctcaggaagcgcaaaaatcgtcgccgttgaaagtctctggcacgaaggccgatctgattcaggccgtgaaatcagtcaacccggcagtggtattcgccgacgaattgctggatgcgtggcgggagaacaccgaagggaaagtgctggtcacccgccaacagctcagcaccgcgctgaacattcagaaagccctgctggagcacccgaccgccggcaaattgctgactcacccaagccgcgctgtcgaggttagctattttgggattgatgaggaaaccgggttggaagttcgggtacgccctgaccttgagctcgatatgggcggcctgcgcattggcgccgacctgaaaactatcagcatgtggaacatcaagcaggaaggcctgcgtgcgaagttgcaccgggaaatcatcgatcgggactatcacctgagcgcggccatgtactgcgaaactgcggcgctggaccagtttttctggattttcgtcaacaaagacgagaactaccactgggtcgccatcattgaggcgtctaccgagttgctggaacttggcatgctggaataccgcaaaacaatgcgagagatagcaaacggcttcgacactggtgaatggtcagcgcctatcacagaagactacaccgacgaactgaacgattttgatgtgcgccgccttgaagcgttgcgcgtacaggcataaggggaaaatcatggaaaacacaaatattgttaccactgagcagcaggcaccaaacaccatttctgccagtaacgcaatttttaacgttcaggcactgggtcagttaacagctttcgctaacctgatggcagactcacaggtgacggtaccggcacaccttgcagggaaaccagccgactgtatggctatcgtcatgcaggctatgcaatggggcatgaacccttacgctgtggctcagaaaacacacctggttaacggtgttcttggttacgaggcacaactggtcaacgcagtaatcgcaagctccagtgccattcatggccgttttcattaccgctatgggggtgactgggagcgctgcaccaggacacaggaaatcacacgcgataaaaacggtaaaaatgggaagtacaccgtcactgagcgcgttcgtggctggacagatgaggacgagatcggcctgttcgttcaggttggtgccattctgcgaggtgaatctgaaatcacctggggagaacctctttacctctccggcgttgttacccgcaattctccgctatgggtttcaaaccctaaacagcaaattgcctatctgggcgttaaatattgggctcgcctgtactgcccggaagtgatcctcggcgtgtacagccctgatgaggttgagcaacgagaagaacgcgagattaaccctgctccagtccagcgcatgagcgtacaggaaatcaccagcgaggttagcaccaggaccagcgcgcaggagtcggcagctaacgttgatgctgttgccgacgatcttcgcgaacgcattgatacagcaagttccgttgatcaggcaaaagcaatccgtgcggatatcgaatcacagaaagcgttgctgggtactgcgctgttcaccgaattaaaaaacaaagcagtgaagcgctattaccaggtcaatgcacagaacaaagtcgaggcagtgatcaactcaattccaaaccctggcgaaccggaagccgcagagatgtttgctaaagctgaaagcacgcttggcgctgctaaacgtcatcttggcgacgaactgcacgataagtaccgcgtcaccctggacgatatgaaaccggaatacatcggctaattgcatcgggagggggtacgccctcccacctgaggaggttttatgcgcctaataaatcgcagtaagcaatcgccattgggccgtcgcgcatgtgatgttgcactggcggcgcatcatgaaaagttcggcgattacggcagacaaaagcacgttaccaattacaccgttgtagtggatggcgtaaaggtgcctgttgaagtagttaaccgggccaccagctacgtagccaccgcaatgatcggcgtccggaaacttagaaatctgccagcacaggcaaactgaatattagcgatggcccgctgcggggccactggagaaaacgatgagcaaaaaaattagagactttgaattgatgagcacccgcgaaatttgctgccagctcaggatttcttccaggacgctggagcgttaccgtaagcgaccaagcgacaacaacccattcccggagcctgactgttcatatatgggtggctccaacaaatggcttaaaaccaaagtcaatgagtggcaggtcagggaaatgtcacgaccaacacgccgtccaatgtcgcatctgaatctgccccgtgacaacaaaggtcgactcatccggtctgacgtggcgtgaactccagaacatcgggctcgatgatgctcatcagtcgggcccaccatttactataagcttctctcatttcttcgatataggtgtatttgtcgtacaccgaccacactccaggcagtttgtgcccgagcatcatctcagcaatatgtggttcagtcagctcggagaaattcgttcgcgcagttctgcgtagatcatggatcgtaaagtgcggaacctgctcgttataagccttcagcatgaacttaacaaggttgctgctgatgctcatatgaaagccttcgctcatcggcttgtctgcatattttgagaaaacaaaacggcctggcgccagctcaatggctcgttgtatcagcgggagcatttcagggatgatcgggcggattatcggcttcttacttttccgtcccgttttatgattttcccacggtacggtccagacgccctcctcaaaatcgaaatgcgaaacttcagcctgacggagttcaccgaccctgcacgcccatatcagggacaatttataaaggatcttgtttcgctcaataaggcgggaatcctcaatagctcgccagacaatcgcaatttctttgcgatccagtgttctctcccccattttcttctgaataccaaaatcacgaccggacatttcagaaagtgggttaacctcaagcaactggcgcttcactgcccatgagtagcactgccgaccgttactaattactcgccgggtgatctcagtgtatccctgcgccagtcggtccagaactgtaagccagttgtgcagcgtcaactgatgcgccggatacttacccagcttagggaatacatgcagctcaaacgaacgcagtatttgatcggatgtttctttctgaacgcataccatcgcatgccattctctgaaaagttcctcgaatgtgtactggctgttgattttagctttatcgaggctttgcctgatccgcggattttctccccgggcaagaatggcggcccacttagttacctcttcgcgcgcggccttcaacccgaattccgggtaactgccgatcgtcatcttgtcctgcttacccaggaaacggaatcggtagaaaaaagtgacggcgccctttttggaaatgcgcacccacagaccgtcccggtctgccttctcctcaactttatcgcgttcgcgcccgaggcacgactttagataactatctgaaatagccatgatttatccctgcatgtgtccatcagaacggaagattctgtgtccatcataggatatggacgcactggtggacacaaaaaccatgactcatgatgtcgtaggttgactgtacatgcaaccagtatcatttttgtgagcgcttattttgcggggatcttgagaggattttgtcgtaggtttgcggagggtggcggggtatcaattatcgatgtgagcaatgatcgaaaagttacgtatgttcttcatagagataaattattatgccttacgcctggttgaccagactttagaggtcgctgttctgagcttaacgtctgttttaactgaaacgccgcattctacactacaacgctaaggcgaggaaatgttcatagtgtaaggagagcgggaactggaaaacgcctcgcttttttcctgtaaaacaccgcaacgcaggaaaagcgcatgcttatcgggacaacaacccaacgcggcaggtgtaccgttgggcaaaacgtttactggcgcgtttcgattgaggtagtttcgacgcgaacaaggtcaggcgggagggcaacgtttaaaatcaccggctgccaggcgtcgcgctccgccagttttcgggaataaccgcgggcaaccagaaaaccgcccacgccgcccagcacggccccgcttaatgcggcaaggtcagatccaaacagcatctgaaaaagcgccgcacaaagaaatagccccgctaaaggcgacatatagaccagcaacgccgaacctaaaaggcttttttcggcgatgcccaactcgactttctgccccggcgccagcggctccgcgcttggcacaacaatggtatgcgtggtttgcggccctaatttattcagcacgcgactgccgcatcccgcacgggaggcgcagctgctgcatgacgctttaacgtcgcagctcaccaccgcctgaccattctgccaggagacaacggttgcccactctttaatcattgtactgccctgaatttgatactgtcggcaatgcgcttcgccgtttgcggcggaagctcgccgacaatggtgatttccgcgttgtcgcgaacgctgctataaaccgttcggcgcccggtgcgcagcatctgatcgctgctgttttgcgtcgcccggttcacattgacggaaaagctaaacagaccgtcagaataaagccgcgattcgataggcaggttatccatcgtcggcaacggacgacggctgctggaaacttcgctaaagccttgcggcacccaggatggactccagttaaatttcgttttttcgccaccgggaacagaaagcagcggcggcagattcgccttcgccagcgcctgcatgttgctgccgatatcctggctcaccgtgaacgcaataacgcggaactgctccagcgtctcgccatcgcgatccagcagatcaacgcgcatcggcagtttggtgtccatgtccatccagacgatatagctgtaacgcgtaccatcgcgcgccacaacgcggataacttcgcacaatctgtctgcgatacgggtgcgtccgacagaaataaagtcgtagtaaggcgccaggcgcttaaagtcggtgtaaatcagggaaggcagagaatcgacaatataatcaccgttcagggtgaacggctcaaggcccggttcaaaataactgatttcattaccacgctgtacgacctcccggcggggaccgtccaactgtagcaattgcgcaagcgggcgaccatccaggcgtgcgtgtcgataacgcagagattcaacgccttgtttcgtgatgctgacgaatgacagctcgtaattcagtgactgactggcgatgttcatctgctgcaataacgccccggacgcagggtcggccgaggcgtttgctgagaagaacaggctagccgccacaagggacatggcaaaccaaagttgcttcattactgcgattgcgttcctaaagtttggattcctggcacctgtaccgcggcttgctgggtttgcgcctgctcaaactgaagctgttcggagtgcagtcggcgctgcagttcatagtcctgcaacatggcattaatgcgacgacgctgctcctgtacctgctgttgctgactgccgacaggcgctgcttcagaaggcactcccagacttaccgggctggctttccccatcataggcagggtattgaaaaccggcgtttcaggttgttgggatgtttcagattgcccattatagtgctggacaccgacgataactgcaagtgaaacgcacgccgccacgcccatttgggtaagctgcgccgcccacggacgcacttttttccagaacggcattttctgccattgctgcggagcgggttgggcctcagggattaatggcgacacctgacgtactggctcgttttcaatagcggccatcacgcgagcggatatatcgaaatggagaacgtcaggcgtatccccccgcattgaatcgcggatcaggtgataactctcccaggttttctgcatttccgggtcgtgcgtaagcgctttgagcagctcactatccaacgtttcgccatccatcaaagcggaaagtttttctttctgcatgcctaataccttttccagtatcccgctatcgtcaacgcctgataagcggttgaactttattatcaatagcttcccgcgcccggaagatacgtgaacgcaccgtccccaccggacaatccatgatagccgctatctcttcatagctcaggccatccagctcccgtaaggtgattgccatacgtaaatcttccgggagggactcaatagttcggaaaactatctgtctcagttcttctgacaacattaagttctcagggttcgaaatttctttcagcgcgccgccgctttcaaagttttctgcttcaatcgcgtctacatcactggaaggcggacgacgcccctgcgcaaccaggtagttcttcgcggtattgaccgcaatacgatacaaccaggtataaaaagcactatccccccggaaagaatccagcgcgcgataggccttaataaatgattcctgtacgacatcgggaacgtcgcccgatggcacatagcgggaaaccagactcgccactttatgctggtagcgcactaccagtaagttaaaggctttctgatctcccttctggacccgttcaaccaggacctggtccgttaactgctcgctcatccgaggtaatgtctccccaaaccaaatttccacgcgctttcgaaacgccactccataagccgcactatgagcaagcaacaggttagagtgtctatgtttcgtaaagttccgttacgcatttgtttttgtttgtcatgttgtagacaggtcttatcttccattataagtctacagatgctgaacaacgcactatctgtacagaaatgcccatttcgtcgtttgcagagtaacctaacagcatctttatttcactacaaaatccgacgctaacaccctgccctataaaatattttttgccgtttatctctcgccgtatttttattttatgtttaataagcacaacaccagcgaaatcataacgtgctttttagcgccatatagtgctaatctgccgcaaccatgtttagtaaattaaacaagaaccatgatgacaactcctgaactgtcctgtgatgtgttaattatcggcagcggcgcggccggactctcgctggcgctgcgtctggctgaaaagcataaggttatcgtcctgagtaaagggccggtgagcgagggctccacgttttatgcgcagggcggtattgccgccgtgtttgatgaaaccgacagtattgcgtcgcatgtcgaagatacgctgattgccggcgccggaatttgcgatcgccacgcggtggagtttgtcgccagcaacgcccgtacctgcgtgcagtggcttatcgatcagggcgtcctgtttgatacgcatgtccagccaaacggcaaggagagctatcatctcacgcgtgaaggcggccatagtcatcgccgtatccttcatgccgccgacgctaccggaaaggaagtcgaaaccacgttggtcagtcgggcgcaaaatcatcctaatattcaggtgctggaacgcagcaacgccgttgatttaattatctccgataaaatgggtctgccggggcctcgccgggtcgtcggcgcctggatctggaatcgcaataaagagtgggttgaaacctgtcatgcgaagtcggtggtgctggcgaccggcggcgcctcaaaggtttatcaatataccactaacccggatatttcctccggtgacggtatcgcgatggcctggcgcgcaggctgtcgggtcgctaatctggaatttaaccagtttcatcccaccgccctttatcacccgcaggcgcgtaattttctccttaccgaagcgctgcgtggcgaaggcgcataccttaaacgtccggacggttcacggtttatgccggacgttgacgaacgcggggaactggcgccgcgcgatattgtcgcccgcgctattgaccatgagatgaaacaactcggcgcagactgtatgtttctcgatatcagccacaagcctgacgattttgtccgccagcacttcccgatgatctatgcgaaactgcttgatttggggatggatttaaccaaagaaccgattcccgttgttcctgccgcacactatacctgcggcggcgtggtcgtcgatgattatggtcgtaccgatgtagacggcttatatgccattggcgaagtcagttacaccggcctgcacggcgctaaccgtatggcgtccaactcgttgctggaatgcttagtgtacggctggtccgcagcaatggatatcgacaggcgaatgccttctgtccacagcgttgacgcccttcccgcctgggatgaaagccgcgtggaaaacgccgatgagcgggtggtgattcagcataactggcatgaactgcgcctgctgatgtgggactatgtgggcattgtgcgcacgacgaaacggctggagcgcgccctacggcgtattaccatgttgcaacaagagattgacgaatattacgccaactttcgcgtctcgaataatttactggagctgcgcaatctggtgcaagtggccgaactgattgtgcgttgtgcgatgatgcgtaaagagagtcgggggctgcactttacgctggattatccgcaacaactggctgaatcaggcccatcgatcctttcgccgttaacgcctcacataaatagataaaatgcctgggtcagcgccgtataactttcagaataatgctggtctgacccgcgaattactaatctgtcgctaaagcactccccggcttgcggggagaatgcgagcaaaacccggtgcggcaagcgcgcttcgttttccgcaacgtcagtacgtagccgcaaatgccatcccatgttgagcgcttgctgcgtaaaagcgttacctatttgttccggcaagactacgcaaaaaaagccatcttcggtaatacaatccgccgcaatagccaataacgtctggtgatccagcgtagcggtgtaacgcgcctgctcccgctgcggcgtggcgcattccacaccgggttcgtaataaggcgggttgctgataataagatcaaagcgtaccgtctggcgaggcgcccaacgctgaatatcgtcagtatgcaccgttattcgatgcggccagggagagtgagcaacgttttcctgcgcttgcatggcagccccggcatccagttccacggcgtcaataggcacattgtcatccgtccgctgcgccagcattaacgccagcagaccgcttccagtaccgatatccagaattcgctttacatccgcgaccggcgcccacgccccgagtaaaataccgtcagttcccactttcatcgcacaccgatcgtgtgcgacaaaaaactgtttaaacgtaaatccgttacgacgaagaacggagccagactgagacatgtaaaaacaaccttgcaaaaaaacggcgacagcgccgggtgaaaacaatacctgagaagggatatccatacaaacagatgaagattgcggccgtaacgtctataatcagcgccccacacagaggtagaacatgactgtaacgactttttccgaacttgaactcgacgaaagcctgctggatgccctccaggataaaggtttcactcgcccgaccgccattcaggctgccgccattccgcctgcgctcgatggccgtgatgtactcggttctgcgccgacaggcaccggtaaaacggcggcatatctgctgccggcgttgcagcacctgctcgactttccgcgtaaaaaatcggggccgccgcgcattctgatcctgacgccaacccgcgaactggcaatgcaggttgccgatcacgctcgtgaactggctaagcatactcatctggatatcgccacgattaccggcggcgtggcctatatgaaccatgctgaagtgtttagcgaaaaccaggatatcgtggtcgccacgacgggccgtctgctgcaatatataaaagaagagaactttgactgccgggcggttgaaacactgatccttgacgaagctgaccggatgctcgacatgggcttcgctcaggacattgaacatatcgctggtgagacccgctggcgtaaacaaacgatgctgttctccgccacgctggaaggcgatgcgattaaagattttgccgagcgcctgctggaagacccggttgaggtttctgccaatccgtcaacccgcgagcgtaagaaaattcaccagtggtactaccgtgccgacaatttcgaacataaagttgcgctgttgaagcacctgctaaaacaagacgatgcaacccgttctatcgtgtttgtacgtaaacgtgaacgcgtccatgaattggctgaaacactgcgtctggcagggatcaacaattgctatcttgaaggtgagatggcgcagatcaaacgtaacgaaggtattaagcgtctcaccgacggtcgcgttaacgtgctggtcgcgaccgacgtcgcggcacgcgggattgatattcctgacgtcagccacgtcattaacttcgacatgccgcgcagtggcgatacctatctgcatcgcattggtcgtacaggccgtgctggccgcaaaggcactgcaatctcgctggtagaagcccacgaccatctgttgctgctgaaaatcggtcgctacatcgaagagccgctaaaagcgcgcgtcattgatgagcttcgcccgaccacgcgtgcgcctagcgaaaagttgaccggcaaaccgtcgaaaaaagtgctggcgaaacgcgccgagaagaaaaaagagaaagaaaaagagaagccgcgcgtgaagaaacgtcaccgcgatacaaaaaatatcggtaagcgccgcaagccaagcggtacgaaaatgcaggagcaatccagcgaagagtgatgataatgccgggttcgttaacccggcatttttttatcttccacggtaaaacacgcctccatacactgcataaatatctgcattgccgggctgaccgctttcccggcatgatgggcgcacagcgccatgatcgatagcgacggcgcgccaaacggcagctctttcaactgaccggtactaagttctcgttcaacggcaaaacgtggtaaaaagctgatgcccaggttagcagccacacactgtttaatgctttcaatactccacagttcaatggtgttttccagcgtaatccgcctctgccgtagcgtactttcaaacagctggcggaagacacattgcggttcattgatgatgaagctacagggaatatgctgatctggctgcgtaaaatcagcatcctgtagcagtggagaggccaccagcgccagcgactgcttccccaattgctgcatcgtgagcgcgtcatcattacctacgcgataaaaaacgcccagatcgacctcgtcattcagcaacgcatcacgtatcacatagcaattcagcgactgtagcgacaatctgacattcggcgctcgcagcttaaaacgttgtaaaacctgcggcattttgtacgccagtaaggtttcacctgtcgccacgcgcagctctccgccgggttccgcatcctgtcttgcggcttcacgaatcgactccatcacacgcgtcagttcatggatatgcggcatcagctttttcccctcattggtcaggcacattcggcgccctattttctcgaacagttgcagggaaaactcacgttcaagctgttgaatatgaaaagttaccgtcgactgagtgcagcacagcttttgcgaagcccgcagaaacgagccctcttccactaccgttttcagcgtaataaaccgacgcagatccataaccaccaacctatcgaaaatctcgaattcagaattaaaaaacattcatttttttaaatatttcatatcgggtactgtctgctaaaacagaggagatgacaagtgacaccgatgcttttaagcgctttctggacttatacattaatcaccgcccttacccccggccctaacaatattctcgcgcttagcgcagcaactgcacatggttttcggcagagtattcgtgtactggcaggtatgagtctgggatttttggtcgtcatgctgctgtgcgccgggatcgcgttttcccttgcggttatcgatccggcaatcattcatttgctcagttgggtgggggctgcgtatatcctgtggctggcgtggaaaattgctaccagtccagcggcggatgagaacgccagaccaaaaccggttggcttttgggtaagctttggtctgcagtttgtgaacgtcaaaattattctgtacggcattaccgctctgtctacatttgttttaccgcaaacgcaggcgctgaattgggtcatcggcgtcagtatattgctggcattgatcggcacgttcggtaatgtgtgttgggcgctggcgggacatctgtttcagcgggcgtttcgccattatggtcgccagttaaatatcattctggcgttactgctggtgtactgcgcggtgcggattttttactgacccaaataaaacaaaagcggaaaaggcccggcctcttccgcttgttattaccggataagccttacaggctttcggtaaaggtacgagcgataacgtcgcgctgctgttccggcgtcagggagttaaaacgcaccgcataaccagaaacacgaatagtcagttgcgggtatttttccggatgcttaaccgcatcttccagagtttcacgacgcagaacgttaacgttcagatgctgaccgccttcaacgcgtacttccggtttaacttccatcggaatttcacggtattcaatctcgcccagtttgctgacagccacaacttcatcttcagcaaagccggattttgcaacgatgcagcgcgcttcgcctttttcgctgtccagcagccagaaggaattcagcaggtcgtcgttagcggctttagtaatctggatacctgtaatcatgtgatgcctccccaggcaaaattatttgatttcggtcggcctaatcccggccaattggtaaaaccattgttgcttgagtgtatatatacccttcgatcacccttcattctttgatttaaatcaataaaaaccacaccacaaaaagggtgatgaagggaatttattgttttacatcaacttacaccattcagacctataaactttttacataaattttcaactatcttttgtaggtaaccgtttttgtagcacgcaggattttgcactgcagaaagaagcagttaagctaagggaactggaaattcgcaggagagcgagatggcgactgagttaacctggcacgatgtgctggctgatgagaaacagcaaccttactttatcaatacgcttcacactgttgctggcgagcgtcagtcgggtatcacggtctacccgccgcaaaaagatgtgtttaacgcctttcgctttacggaactgggcgacgttaaggtggtgatcctgggacaagatccttaccacggccccggccaggcacatggtctggcgttttccgtgcgtcctgggatcgctcccccgccatcattagtgaatatgtacaaagagctggaagcctccattcccggctttgttcgccccgcgcacggttatctggaaagctgggcgcgccagggcgtactgttactgaatacggtgctcacggtacgggcaggccaggcgcactctcatgccagcctggggtgggaaacctttacggataaagtgataagcctgattaaccaacaccgcgaaggggttgtcttcctgctgtggggctcgcacgcccagaagaaaggcgcgattattgatccacagcgccaccatattctgaaagctccgcatccctcgccactctctgcgcaccgcggattttttggctgtaaccattttgcgctaacgaaccaatggctggaacaacacggcgagaaaactatcgactggacgccagtattaccggctgagagtgaataacgttggcgactcgccgttttatcgcccggataacggcgcgaaagcgccttgtctgaccgggcggtagaaagtacatcattggcccggcgcgcgttgcgtcaccgggctgcagcccttacgctttattctgtcgccaccactcggcgagcagtacgcctgtcgcaaccgacacattcaggctttccacgttcccggtgccgttaattttcacgcacagatcgtcgggttcgcgcgccgcttccggcaggtagtcatattcacggcctaagaccagcaccatcttttccggcagggtcgtactaaagagcgcctgaccgcgatcgctggacgtcgtcaccacggtgtaccccgcctgacgaaaatcatccagtacgtcaacaatgctttcaccagtgatcggctggacatgctccgccccgccttccgcggtacgaatcgccgcgccggactccagcaacgccgcatcctgtaccaccacgcctttcacgccgaagtgcgcgcagctacgcatcatgccgcccagattatgcgggttagcgacatcttccaacgccagcacgcagtcttgatccgccgcctgctttacccattgcttaacggtcgtaccgttacgctttttaatcaggaaacacacgccaccgtggtgctcagtcccggaagcttttgccagttcggcttcatccaccacatggtaggctttacgattcgccgccatccagcgcagcgcctctttaaaacgcggcgttacgctttggataaaccatgcgcgcacgatggcgtcaggacggctctggaatagcgcctggcaggcgttttcaccgtagacgcgcgtctcttccgcacgctggcgacgcaaaacttcagggtcaataaaacttttaccgctaataccaccatgatcgactttctcaggcgtttcatcgcctggcgcgcgggacacggtgcgccacggcgaagtttcatgtttacggtcacggctctgattatttcgctcatcacgggcggggcgacgtccaccgtcagtgcgagactttgctgggcggcctccccctttcccggtacgcgggttatgggtgcgtttatcagagtcatcatcactacggacatacatcactttgactttgccgcttttgttttttaattcatcgttcatgcttttctccaccagcgctgcgcgaagcgcgaagattacccgatgtgcatccggttagccatgatttcgtttaaaagcttgcgactattgtactcattgaataaaacacattgttgtttagcacagactcctcgataatatgtaacattatagaaacatcccgcgcgtagcgggacgtcttccgacgtattcagaggttagctatgaacaccgtttgtacccattgtcaggccattaaccgcatccccgacgatcggcttcaggatgcggcaaaatgtggacgctgcggtcatgagttgtttgacggagaagtcattaatgcgaccggcgaaacgctggacaaactgttgaaggacgatcttccagtggtgatcgacttttgggccccctggtgcggcccttgccgtaactttgcgccaatcttcgaggatgtcgcagaagagcgcagcggtaaagtccgtttcgtcaaagtgaataccgaggcggaacgggaactcagcgcccgtttcggtatccgcagcatcccgacgattatgatttttaaacatggacaggtggtcgatatgcttaatggcgcagtgcctaaagcgcctttcgacagctggctgaacgaagcgctgtaaacgccacggggcgcatcttgtgccccgttttcacctctgccacaatagcgtttttctccgcaaacgctttctatgaccaataacgctgtccttcagttacgcgccgaacggcttgcgcgcgctactcgcccttttcttgccagaggcaatcgggttcgccgctgtcaacgctgcctgctgccgctaaaatcttgcctgtgtgatacgttaacgccttctcaggcgaaaagccgtttttgtctggtcatgtttgacactgaaccgatgaaacccagcaataccggccggctgatagccgatattttgccggataccgcggcgtttcagtggtcgcgtaccgagccgccgcaggcgttgctggagctggtacagcatccggattatcaaccgatagtggtctttcctgcgtcctacgccggcgaagcgcgcgaggtcatttccaccccgcccgccgggaaaccgccgctgtttattatgctggacggcacctggcccgaagcacgtaaaatgtttcgtaaatgcccttatctggatcatctgccggtcatttccgtcgatttatcgcgtctttcagcttatcgtctgcgtgaaatccatgccgaagggcaatattgtaccgccgaagtcgccatagcgttgttagatctggcgggagataccgaggcggcaaccagtttaggtgaacatttcacccgtttcaaaacgcgctatctggcaggaaaaacgcaacatccgggaaacgtcacagcataaaatagcgaaagcgtttaaaattatccggtcacttctgtgtaagggaaaccggtatgagccagcaaggactggaagcgctactgcgaccaaaatcgatcgcggtgattggcgcatcaatgaagccccaccgcgcgggttacctgatgatgcgtaacttgttggcgggcggattcaatggccccgtccttcccgtgacgcccgcctggaaagccgttttaggcgtcatggcctggccggatatcgccagtcttcctttcacccccgatctggctattttatgcactaacgccagccgtaacctggcgttactggacgcgcttggcgcgaaagggtgtaaaacgtgcattatcctttctgctcccacgtcgcaacatgaagaacttcttgcctgtgcccggcattataaaatgcgtctgctgggtccaaacagtcttgggctcctcgcgccgtggcaagggctgaatgccagcttttctcccgtcccgattaaacagggcaagctcgcttttatttcccagtctgccgccgtgtccaatactattcttgactgggcgcaacagcgtgaaatgggcttttcctactttatcgcgctgggcgatagcctggatattgatgtcgatgaactactggactatctggcgcgcgacagcaagaccagcgcgattttgctctatctggaacagttaagcgacgcccgccgttttgtttccgccgcccgtagcgcttcacgtaacaaaccgattctggtgattaaaagcggccgaagcccggcagcccagcgtttacttaataccagcgcgggaatggaccctgcgtgggatgcggccatccagcgcgcaggcctgctgcgagtccaggatacgcacgagcttttttccgccgtcgaaacactgagccatatgcgtccgctacgcggcgacagactgatgatcatcagcaatggcgccgcgcctgccgcgctggcgttagatgagttgtggtcgcgtaacggcaagctggcgacgttgagcgaagagacctgcctgcaactacggcaggcgcttcccgcgcacatagatattgccaatccgctggatctgtgtgatgacgccagcagcgaacattacgtcaaaacgctggatatcctgctcgccagtcaggattttgacgcgcttatggttatccactctcccagcgctgccgcgccgggtacagaaagcgcccatgctctgatcgagacgattaagcgccaccccagaggcaagtttgttacgctgctgacaaactggtgcggcgagttctcgtctcaggaggcaagacggctattcagcgaagccggattaccaacctaccgtacgccggaaggcacgattaccgcgtttatgcatatggtggaataccggcgtaaccagaagcaactgcgggaaacgccagcgttgccgagtaacctgacgtccaataccgctgaggcgcataatctgttacagcgggcgattgcggaaggcgccgcctcactggatacccatgaagtacagccgattttacacgcctatgggctgcacacgctcccaacctggattgccagcgacagcgctgaagcggtgcatattgccgaacagataggctatccggtagctctcaagctgcgctcgcccgacattccgcataaatctgaagttcagggggtcatgctttacctgcggaccgcaagcgaggtacaacaggccgcgaacgctatttttgatcgtgtaaagatggcctggccgcaagcgcggattcacggtttgctggtacaaagcatggctaaccgcgccggcgcgcaggagcttcgtgtggtggtcgagcacgatccggtgtttggtcctttgattatgttgggtgaaggcggcgtagagtggcgtccggaagagcaggctgtcgtcgcgctgccgccgctcaacatgaacctggcgcgctatctggtgattcagggcattaaacagcggaaaattcgcgcccgtagcgcgctgcgtccgctggatattgtcggtttaagccaattgctggtccaggtttcaaacctgattgtcgactgcccggaaattcagcgtctggatatccatccgctgctggcttccgccagtgagtttaccgcgctggatgtgacgctggatattgccccgtttgatggcgataacgaaagtcgacttgcggtacgcccctatccccaccagcttgaagagtgggtggagatgaaaaatggcgatcgctgcctgttccgtcctatcctgccggaagatgagccccaactgcgacaattcatcgcacaggtcaccaaagaggatctttactaccgttatttcagcgagatcaacgaattcacccatgaagatttagccaacatgacgcagatcgactacgatcgagaaatggcctttgtggccgtgaggcggatggacaatgctgaagagatcctcggcgtaacgcgcgcgatctccgatcctgacaacgtagatgccgaatttgccgtattggtgcgttcagatctcaaagggttgggtttaggacgccgtttaatggagaaattgattgcctatactcgcgatcacggattgaagcggctgaacggtattacgatgccaaacaatcgcggcatggtcgcgctggccagaaaactgggatttcaggtcgatattcagctcgaagagggcatcgtgggattgacgctgaatctggccaaatgtgatgaatcgtgagtaatgtactggaaatgttgaccactttaacgggtactgatgttattattgctcgcttatgtcgtctgcatagcacagaggacccttcaatgaacagagaagaaatgcactgtgatgttgtcaaaatttaagcgtaataaacatcaacaacaccttgcccaactccctaagatttctcagtcagttgatgatgtagatttcttttatactcctgctacttttcgggagacactgctggagaaaatcgccagcgcgacgcagcgtatttgtatcgttgccctgtatctggaacaggacgatgggggtaaaggtatactcgacgcgctctatgcggctaaacggcagcgtcctgaactggacgtgagggtgctggtcgactggcatcgcgcgcaacgcgggcgcattggcgcagcggcctcgaataccaatgcagactggtattgccgactggcgcaggaaaaccccggcattgatgtcccggtttacggcgtaccgattaatacgcgagaagcgcttggcgtactgcattttaaaggctttatcattgatgatagcgtcctgtacagcggcgccagcctgaacgatgtctatctccatcagcatgacaaatatcgctacgatcgctaccagctgattcgcaatcggcaaatggcagacatcatgtttgactgggtgacgcaaaatctgatgaatggccgtggtgtgaatcgtctggataatacccagcggccgaaaagcccggagattaaaaacgatatccgcttataccgtcaggagctgcgtgatgcgtcatatcattttcagggtgacgctaatgacgagcagctctccgttacgccgctggtcgggcttggaaagtccagtctgttgaacaaaaccattttccatctcatgccctgtgcggagcataagctcaccatttgtaccccttacttcaatctaccagcggtactggtgcggaatattattcagctactgcgcgacggaaagaaagtcgaaatcattgttggcgataaaaccgcgaatgatttttacattccggaagatgaaccgttcaagatcattggcgcgctgccctatctctatgagattaacctgcgccgcttcctgagccgtttacagtattacgtcaataccgatcagcttgtggtgcgtctgtggaaagatgacgacaatacctatcatctgaaagggatgtgggtagatgataaatggatgctactcaccggcaacaacctgaatccccgcgcctggcgtctggatctggaaaacgccattttgatccacgatcctaagcaggagcttgcccctcagcgggaaaaagagctggaacttatccgaacgcacacaaccatcgtaaaacattatcgtgacctgcagagcattgccgactatccgataaaagtgcgtaaattgattcgccgtctgcgccggatccgcatcgacagattaattagccgtatcctgtaatcgaagccccgtcctgtacggggttttctcttaggagtgaactggtgcgcgtgttgattccttttacggtgttgtttctctccgggtgcagccatctggctaacgaccactggagcggtcaggataaagcccagcattttatggcatcagcgatgctatcggcagccggtaatgagtatgcgcgtcaccagggagtaagccctgaccgcagcgcagcgatagggctgatgttttctttgagtctcggagcctcaaaagaactctgggacagccgcccggaaggcagcggctggagctggaaagattttgtctgggatgtcgctggcgcgacaaccggttacgctatctggcaaatggcgcgatactaaaggcgtaagccctttcctttacggtgcaacatcaacgaaaccaggaaagccagaacggccatcgcggtaacataccagaagaacgaactctccataccgacagattttagcgacagcgcgacatattccgcagagccgccaaataacgcgtttgctaccgcgtaagataaaccgacgcccagggcgcgaacctgcgccggaaacatctccgctttcaggatcccgctaatcgaggtatagaaactcacaatcaatagcgcgcatatcactaaagcaaatgcggcataaggcgacgtcacattctgcaacgcggagagaattggaacggtgaaaagcgtcgcgagtgcgccaaaacatagcatagaggtgcgcctgccaatcttatcggataacgcgccgaataacggctgcaccaacatgaaaacacacagcgcagccgtcataatgccgctggcgacattggcatgcatacctgctgtatttaccagatatttctgcatataggtggtgaaggtataaaagcacagcgagcctgccgcggtgaaaccaagcaccatcaaaaaggctttgcgattacgccacaaacctttcaacgaaccggcttcttttaatgcgcgagtctcatgcttcgaggtttcatccagctggcgacgtagccataacgccacaaccgccagcacggcgcccagcgcaaagggaatacgccatccccaggcacgaagctcagcatcgtccagaacctgctgcaaaatcacaacgaccagcaatgccagtagttggccaccgataagcgtaacgtactgaaacgacgcgaaaaatcccttacgaccttcaagcgcaacttcactcatatatgtcgcgctggtcccatactctccccctaccgagagcccctgaaataaccttgcaataagtagcagcgccggtgcccaggtgccgatggtatcgtaaccaggtaagcaggcaatcaccagcgaccccatgcacatcatgcacaccgaaatcaacattgaggctttgcgcccgcgtcgatctgcaatgcgtccaaatagccaaccaccgataggccgcattaaaaaaccggcggcaaagacgcctgccgtttgcaaaagctgagtagtggtattaccagaaggaaagaagatatgtgcaaaatagagcgagcagaaagagtagacgtagaaatcaaaccattccactaagtttccggaagaggcccccacgatagcccatatgcgtcgccgcatctccggagcctcagcgttgtttttatctatacgctgaataatttctgccatactgttctccttgttgccaggcttaatcggccttttattttggagattcagattacgcgagacccaaaagtaaataaagtgttaattatttgtttgctaatttttatccccaccgtgcctgatgctggcgtttccgtttcagatagtcttcgtcctgacggattttatcccaccaacctttgaaaaccgttgccgccgcggccttaataggatcattaccccgtgtattcaggctgccgtcttctgcatactttttaccgcctttatagttagcgtatcgcctggcgcgggtgtatcccatctgaataaatttacgcgccatgtccataccaacgaaatcatcctgctgccggtaagcttcgaacaactggtagatctgttctgcggatttcatcgccgatgcttcatctttatagcgccagaaaggaagaatttcgcttttgtagggttcaaccagtagcaccccctgctcgcctcgtccaacctgatacaattcaggctgctggcggaagtcgatgctggaaaagtcctgctggtagttaaaaggtttgatagccaatgaaaatcctcactgcttatataagcacgtgtaaaggatagttcatcgttaatgattgggtgggttgtgctcttatcagttctacaagagcaccaacttcgtaggcgggataattcctgtaggccggataaggcggagccgccatccggcagaaacagacaaaaacaaaaggccctgtcttccgacagggcccttcgttttatttgatgcctggcagttccctactctcgcatggggagaccccacactaccatcggcgctacggcgtttcacttctgagttcggcatggggtcaggtgggaccaccgcgctagtgccgccaggcaaattctgttgccagaaacgaatcttttacaccgatgctgcgttggctgcattcgtaaagtcagtcacatacttctgtatgctccttcctttccttcatttgccgccttgcctcagcgtaaaatctttcgttcccgaaaatccggaatcactgctgaaaatcgtcttctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcgactgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgcctcagtgttaaagtgaaccggatttacctggaacacacacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggtcaccttcgcaggcttacagaacgctcccctacccaacaacgcatcagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccaattaagactcggtttccctccggctcccctattcggttaaccttgctacagaatataagtcgctgacccattatacaaaaggtacgcagtcaccccaccccaaagcattcaccgcttgttttgtgtgttgggcgtcgcaaacgacgctccgccaccgcgatgctgctttgcagggccttcaacaccagagaatgctttggtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcacatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgagtcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttcttacgattcatcatcgtgctgcgaaaatttgagagactcacgaacaactttcgttgttctgtgtttcaattttcagcttgatccagatttttaaagagcaaatatctcaaacgtgactcgtaagtcagttttgagatattagggcaggtgactttcactcacaaaccagcaagtggcgtcccctaggggattcgaacccctgttaccgccgtgaaagggcggtgtcctgggcctctagacgaaggggacgtatcagtctgcttcgcaagacgccttgctatttacttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccgacctaatcgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccgcaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagcaagctgcttcctgttaccgttcgacttgcatgtgttaggcctgccgccagcgttcaatctgagccatgatcaaactcttcaatttaaaagtttgatgctcaaagaattaaacttcgtaatgaattacgtgttcactcttgagatttggtattcatttttcgtccgaggacgttaagaatccgtatcttcgagtgcccacacagattgtctgataaattgttaaagagcaggtgcgacgcggcttgcagctcaccgtcgcgaggtggcgtatattacgctttcctctttttgagtcaagcctttattttcgctttcctcacagacttcttaacgaagcttttctgacccggcggcctgtatgccgttgttccgtgtcagtggtggcgcattatagggagttattagagcctgacaagacctaaatgcaaaaaaaagctcaaccgttcacttttcaaacaacatttgaaccaaaagcctattttcgcctggtttttaaacaaaaacgagcccgtcagggcccgttttattcaaatttgtgacttactgcactgccacaatacgatcatcattggcttcaaggcgaatcactttgccaggaaccagttcaccagacaggatttgctgcgccagtgggttttcgatctgctgttgaatagcacgttttaacggacgcgccccgtagaccggatcgtaaccgttggcgctcaacagtttcagcgcctcgtcggagatatggatttcataaccacgttcttccagacgtttgtacagacgctgcagctggatctgagcaatagaagcgatgtgttgttcacctaacggatggaataccacaacttcatcaatacggttgataaattccggacggaagttttggctaaccacacccagcaccatctctttcattcgaccgtaatccagttcgccaaagcgctcctgaatgagatcggaaccgaggttagaagtcataatgaccaccgtattacggaagtcgaccgttctcccctgcccgtcagtcagtcgaccgtcgtccagcacctgcaacagaatgttgaatacatccggatgcgctttttccacttcatccaacaagatgacggaataagggcgacggcgcaccgcttccgtcaaataaccgccttcttcatagccgacatatcccggaggcgccccgaccaaacgagacacggagtgtttctccataaactcagacatgtcgatacgcaccatcgcgtcgtcgctgtcgaacataaagttagccagtgctttacacagttcggttttaccgacccccgtcggccccaggaacaggaaggaaccaatcggacggttcggatcggacagcccagcacggctacgacgtatggcgttcgatactgcttcaacggcttcattctgcccgatcacacggctgtgtaactcttgttccatacgcaacagtttttcacgttcgccttccagcattctggaaaccggaataccggtccagcgcgctagcacttcggcaatttccgcatccgttactttgttacgtaacagacgcatggttttaccttccgactgggtcgcggcttccagctgtttttccagctccggaattttgccgtactgcagttcagacattcgcgccaggtcgccaacgcgacgcgcctgctcgatggcaatcttcgcctgctccagctccgctttaatagtttgcgtaccagagagcgacgctttttccgctttccactcttcttccagctcagaatactggcgctctttgtcgtccagttcttcgttgagcatatcgagacgttttttactcgcctcgtcagactctttcatcaacgcctgctgttccagtttgagctgaataatgcggcggtcgagtctgtccagctcctccggcttagagtcaatctgcatacgaatgctggatgcagcttcatcgatgaggtcgatagctttatccggcaactgacggtcggcgatatagcggtgagataatgttgccgccgccacaatcgccgggtcagtgatctgcacatggtggtgcagctcgtaacgttctttcaggccacgcagaatagcgatggtgtcttccactgaaggttctgcgacaaacactttttgaaaacgacgttccagcgccgcgtctttttcaatgtactgacggtattcatccagcgtggtggcgcccacacagtgcagttcaccacgcgccagcgccggtttcagcatattcccggcgtccattgcgccatcagccttacctgcgccaaccatcgtgtgcagctcgtcaataaacaggatgacgttgccttcctgtttcgccagatcgttcagcacgcctttcagacgctcttcaaattcgccgcgatatttcgcccccgccaccagcgcgcccatatccagcgccagtacgcggcgaccttttaagccttcagggacttcaccgttaataatgcgctgcgccagtccttcaacaattgccgttttaccgacccctggctcaccgattaacaccgggttgtttttggtacgacgttgcagtacctgaatggtacggcgaatttcttcatcacgaccaattaccgggtcaagcttgccttgttcagcccgctcggtcagatcgacggtatattttttcaaggcctgacgttggtcttcagccccttgatcgttcacgctttcacctccgcgcatctgttcaattgcctgagtgatattggccgtggtcgcaccggctgatttcagcagatcggttaacgtgccgcgagactcaagcgccgccagaacaaacagctctgacgaaataaaattgtctccccgtttttgcgccagcttgtcgcaaaggttcagtacgcgtaccagttccgaagaaggctgtacgtcgccgccggtgccttccacctgcggtaaacggctcagcgcctgatcgatagcggtgcgcaactggccagcattaatgccggcggaggttaataaaggacgtatcgatcccccttcctggttcagcaaggcgctcattaaatgaagaggttcgatgaattggttgtcgtgccccagcgcgagcgactgggcatcggcaagagcaagctggaatttgttagtaagacgatccagacgcataactcctcccataacaggtcaaaattgctactggagattaaatgaggtcatccctcaattattcaaggtgaatgacctgaattatgtgaaaagaaagttacccgtaccggatcgtcttgattctttaggttatatcagccaaataaaacttgccatacgacctgtcgtcttgtcgcgacgataagagaagaaagtctcactttcgctaaaggtgcagcgatccccgccatagacatgttcaacgccggtattcgccagacgttggcgtgcaagctgataaatatccgccagaaatttttccccgtgcggcaaaaatgcgctatcggcttgcgcatcttttgctaaaaatgcgtcacgcacttccggccccacttcaaacgcggtcgggccgatcgccggacctaaccaggcgatgatattttctggtttgtcagcaaagcaggtgacagtttcctccagtacgccttcacataatccgcgccagcccgcatgagccgccgccacttctgttccctcacggttacagaatagcacaggcaggcagtctgccgtcattaccgcgcagacggttcctggcgtattgctgtaagacgcatccgcacgtttggaggcataaggttctccggtaagcctcaacacatttttaccgtgaacctgttcaagccagacaggtttcgaaggcagattgcccgccgcaaacagacgcttgcggttctcttcaacatgctccgggttatcgccgcaatgcgcgcccagattcagcgagtcgtaaggcggtaaactcaccccgccaatacgggtagaactacaggctgcgacgcctttcggcagcggccactgcgggacaatcagtgcattcataaccagtccacatcatctttatgatcttcaaaatcggcgcgcatcgcatcgataaggtccaccatatcttgtggaatcggcgcgtgccactccatttcgatacccgatacaggatggtagagacgcagcatcgttgcatgaagcgcctggcggtcaaacttacgcagagtggaaataaactcttccgatgcgcctttcggtggacgtggacgaccaccgtagacctgatcgcccactaacgggtgcgtaatatgcgccatatgcacgcggatctggtgcgtacgcccggtctccagacgcagcctaagacgcgtgtgcacacggaaatgttccataatgcggtagtgggtcaccgccggtttgcccatgggatgcactgacatatgggtacgtttggtcgggtgacgactgatgggttcattcaccgttcctcccgccgtcatatgtccgatcgcgaccgcttcatattcgcgggtgatctcgcgcagctgcaaagactccaccaggcgcgtttgcgccggaacggttttggccaccaccatcagccccgtcgtgtccttatccagacgatgtacaatgcccgcgcgcgggacatccgcaatcggcggataataatgtagcaacgcgttcagtaccgtaccgtccgggttacccgcgccaggatgtaccaccagatcgcgtggtttgttgataaccagaatatcgtcatcttcataaacaatatctaacgggatatcctgcgcttcaaaacgaatctcttcgtcgatctccgcatcaatagccacccgctcgccacctaacactttttcttttggcttatcgcaaagttgaccattgaccaacacgcgctgattcaaaatccattcttttatacgcgaacgtgaataatccgggaacatttcggccaaagcctgatctaagcgttgaccgagttggttttcggagaccgttgcggtgagttgtactcgttgtgccatatacagcttcttcgtttaacgttgggttttacggctttgccgtttaatatagtgtgctattgtagctggtcttaaccgggagcaggaacagagaatctcccgtaaaacattttgaggaaagtcaaaacgtcatgacgcgcatgaaatatctggtggcagcagccacgttgagcctgtttctggcgggttgctcgggttcaaaggaagaggtgcccgataatccgccgaatgaaatctacgcgactgctcagcaaaagctgcaggacggtaactggaaacaggcaataacgcaattggaagcgttagataatcgttatccattcggaccgtattctcagcaggtgcagttggatcttatctacgcctattacaaaaacgccgatttgccgctagcgcaggccgccatcgatcgttttatgcgtcttaatccaacgcaccctaatattgactatgtcatgtacatgcgcggcctgacgaacatggcgctggatgatagcgcgctgcaaggtttctttggcgtcgatcgcagcgatcgcgatccgcaacatgcgcgggcggcgttcaatgacttttcgaaactggtacgcagctatcctaatagccagtacaccaccgatgccactaagcgtctggtattcctgaaagaccgtctggcgaaatatgaatattccgtcgcagagtactataccgcgcgcggcgcatgggttgcggtcgtaaaccgggtagaaggtatgctacgcaattatcctgatacgcaggccacgcgcgatgcgttgccgctgatggaaaacgcctatcgtcagatgcagctgaatgcgcaggctgacaaagtcgcgaaaattattgccgctaacagcaaaaacacctgaagcaatacaaacaagcaaaacggcagccttccggctgccgtttttttattcggtatctgatgcaacagaaatgatttcactgcaacgcatccagtcaaatatggcctgctttcagccattcctcaagtaaaagatcgcttcttcctgcgatgcctcacaaaaagttcgccttgacaaaaagtgacaaaataatgtgatttacatcacacattttgacattaagaacggtatgctggaatcaccaagacgggaaagacaagaggtaaaatttatgacaatgaacattaccagtaaacaaatggaaattactccggcaatccgccaacatgtcgcagaccgtctcgccaaactggaaaaatggcaaactcacctgattaatcctcatatcattctgtctaaagagccacagggctttattgctgacgccaccattaatacaccgaacggacatctggtcgccagcgcaaaacacgaagatatgtacaccgctattaatgaattgatcaacaagctggaacggcagctcaataaagtgcagcacaaaggcgaagcccgtcgtgccaccgcatcggtgaaagatgccagcttcgtcgaagcagaagaagagtagtcccttacattgagtgtatcgccaacgcgccttcgggcgcgttttttgttgacaggattaaaacagtacgggtactgtacttacgtacacaaaggaaacagttatgaagctcacccggtttttcttcgcattcttttttatcttcccctgaccgggaggcgtttcgtcatgtgataaagaatgcgaagacgaacaagaaggcctcccccaccgggaggccttttttattgataacaaaaaaggcaacactatgacatcggaaaacccattactggcgctgcgagataaaatcagcgctttagacgaagagttactggccttactggcaaaacgacgcgcgctggcgattgaagtgggacaagcaaaactactgtcgcatcgtccggttcgggatatcgatcgtgaacgcgcgctgctggacaggctcatccatctcggtaaagcccaccatctcgacgcacactacattacccgtctgttccagcttatcattgaagactccgtgcttactcagcaggcgctgctgcaacaacatctgaataatactcaccctcattcggcacgtattgcgtttcttgggccgaaaggctcctattctcatctcgcggcgcgccagtatgctgcacgccattttgagcaatttattgagagcggttgcgcaaaattcaccgatatttttcatcaggtcgaaaccggccaggccgattacgccgtggttccgatagagaacaccagctccggcgctatcaatgatgtgtacgacttattgcaacacaccagtctgtcgattgtcggtgagatgactgtcactatcgatcactgcgtgctggtttccggcgctacagatctgaataccatcgaaacggtgtacagccatccgcagccgtttcagcagtgcagtaaatttttgagccgctatccgcactggaaaatcgactataccgagagtacgtcggcagcgatggaaaaagtcgcgcaggcaaactctccgcgcgtcgcggcgctcggcagcgaggcaggcggcatgttgcacggattacaggtgctggaacgcatcgccgcaaaccagacgcagaatatcacccgctttctggtactggcgcgcaaagccattaatgtttccgatcaggttccggcaaaaaccactctgttaatcgccaccgggcagcaagctggcgcgctggtcgaagcgctgctggtgctgcgtaaccacaatctcatcatgacgaaactggagtcgcgccccattcacggcaatccgtgggaagagatgttttatctcgatattcaggcgaacctggagtcgcaggtaatgcaaagcgcgctaaaagagctgggcgagatcacgcgctcaatgaaagtgcttggctgctatcccagcgaaaacgtcgtgccggtagaacctgcctgacgttcaataaaacggcttttcttcatccctgcgacggctacctgcagggtgaagatggcgccggagagcggataatccgccacttcctgagcagacatattttctctggtagttgtaataaacagcgttttcatatctgcgccgccaaagcaaaccatcgtcggacaacgtaccggcaaccggtactcttccagctgctcttcttgcggtgagaaacgcgccacgcgccagccgtcaaacatcgcgctccagtagcacccttcgctatccatcgccgcgccgtcgggaagtccttctccttcgccaaaatggcgaaaaagttcacgcttgcccggatcgccatgcttatcaagtaacgtgcggtatatcacgccattcggcgtatcggaggtatacatccactggttatccgggctgaacgccaggccgttgtgtccctggatatcgcactggatcacttttgccgtcaggtcatgatcgatccgcatcagcaacgcgccattatagtcacctggcgcccagaacgttccggcataaaaacgtccatcgccatcagtgccgccatcgttaaaacgcgccagtttcgtattagagggattgtcgcaaaccttacgctgcaataatccatttttatcggccagccagatagcatgacgcatggccacaataaatccgccctgctcacgcaaggcaaaacagcccacctcttccggaaacaccagcacgctatgcgtcccactcgccggatggtaacgatggatctcctgttccaggatatcggtccaatacagcgcgctttcatcctcgctccatgtggggcattctggtagatgtccgacataatcaaataaaacgtgcggcgtagtcataacggttccttaaacgaaaaaagccagcaaagctggcttttagtatagatgtcatcattatggtcggctgtcattcgcctgacgcaataacacacggctttcattctggaagcgtctggcataatcgccaaaccagtgttcaactttgcgaaaactgtcgataaaagcctgcttatcaccctgttccagtaacccgatcgcatcgccaaaacgtttatagtaacgcttgataagcgccagattgcgctccgacgacataataatgtccgcatacagttgcgggtcctgggcgaacagacgcccgaccatcgccagctccagtcgataaatcggcgatgatagcgccagaagctgctcaagctggacgttctcttccgccagatgcagcccataagcgaaggtagcaaagtggcgcaacgcctggataaaagccatgttctgatcgtgctcgacagcgctaattcgatgcaaccgcgcgccccacacctggatttgctcaaggaaccactgatacgcttccggttgacgcccgtcacaccagaccaccacctgcttcgccaggctcccgctgtccggaccaaacatcggatgcaagcccaacacggggccatcatgggccgccaacattgcctgcaacggaccgcttttcaccgatgccagatcgaccagaatacagtcggacggcaggggcggcagttgcgctatgacctgttcagtaacatgaatcggcacgctgacgatcaccattccggcatcggcgacaatgtccctggcgcgcggccagtcctgctgttccagaatacggacctgatagcccgacagcgtgagcattttttcaaacagacgccccatctgtccgccgccgcccacaatgacgaccggacgcagagaaggacaaagcgttttgaaccccttatcattttcgctggagtaagattcacgcattacccggcgcaggacatcttcaatgagatcgggcgggacaccgatcgcttctgcttccgcccgtcgtgaagccagcatagaggcctcacgctccggcacgtaaataggcaggccaaaacggcttttcacctcgccgactttggcaaccagttccaggcgcttagccagtaaattcaacaacgctttatcgacatcatctatttgatcgcgtaatgcggtcaattcagcaaccataacaacctcttatgcgacgcgcaccgccagctggccgctcaaatctttatgaatttcacgtaacagggcatcggtcatctcccagctaatacaagcatcggtgacggaaacgccatacttcatttcgctgcgcggctgttcggaagactggttaccctcatgaatattactttcaatcattaagccaatgattgaacgattgccatctttaatctgcgcaaccacagattcggcaacggctggctggcggcgataatctttattggagttaccatgactgcaatctaccatcagcgaaggacgtagtcccgcctgttccatctctttttcacactgagcgacatctgccgggctatagtttggcgctttgccgccacgcagaatcacatggccatgcggatttccctgggtttgcaataacgcaacctgaccggcctggttaatgccaacaaaacgatgaggttgcgcagcggcgcgcatggcgttaatcgctgtcgccaggctgccatccgtgccgtttttaaagccgaccggcatagaaagaccagacgccatttcgcggtgggtttgcgattcggttgtgcgcgcccctatcgccgaccagctaaacagatcgcccaggtattgcgggctgttcggatccaacgcttcggtcgccaatggcaaccccatattcaccagttccaccagtagctgacgcgctattttcaacccggcttccacatcaaatgagccatccatgtgaggatcgttaatcagccctttccagccgacggtagttcgcggcttttcaaaatagacgcgcattaccagatagaggctatcgctgacctctgcggcaagggctttaaatcgacgggcatattccagagcggtttcaggatcgtgaatagaacaaggaccgcataccaccaacagacgcggatcgcgcccggcaataatgtcagaaatgattccccgggactgcgctatctgcgcttcctgcgccaggctcaagggaaaggccgctttaagctgctccggcgtcattaatacctgttcatcggtgatacgtacgttattcagcgcgtctttttgcatgatggcgatcctgtcttttcttgtttgcgatagttgatcctccacgaggatgtttaaaccataccacaaaaagtaaagatttcaatccatattacgtaaaataaactttacaccatgcgcaatcgtcgattaatctccctcatttcgtatcaaaaactttacacaacaagtgaattattttattcccagcctcagaaaagcggtaaaatgagcgatgctcgctattttttgattattttttctccgcacacatatttttactttctgatatagggtgattaataccattatcacaagaatttaatatcagggatatcacttaaattattcatattatcaataagacataatgacgatatggcaaaataatgttattttgctacaaacaatcacggatgtattttaatgctttacgactgaagatggtggggacttgttaatgcgtttttctcaccgatttatccttctgttatcgctattattagcaagcttgcctctgtatgctcaacgcgtcacggaagaagagaaatccgtacgcgccatcgtctccggtatcgtcagttatacacactggccggcgttatccgggccgccaaggctatgcatattttcatctgcgcgttttgtcagggtacttagcgaagaggctgactgggctttcccttatcaaccgcttgtcatccgtaccacacaagaagccctgagcgcccgctgtgatggtttttactttggcaatgaatcgccagcttatcaggtggagttaacgcgtcattatccagttaatgccttgttattaattgccgagcaaaataccgaatgtattattggcagcgcattttgtctgatcattaacaatgatgaagtcaaattttccgtcaacctggactccctctcgcatagcggcgtgagagtaaatccagaagtattaatgcttgcacggaatcaaaagcatgaataaggaattttctctgtccaggccaacatttaaacgcacactacggcggattagtataatcagcgtgctgcttacaatgacattgatctggctattaatttgcgttgcgtctgtccttacgctcaaacagtatgcgcaaaagaatctcgatttgaccgccgccacaatggcccatagccttgaagcggcactggtattttccgataacgcggccgcagcggaaacgctcgccacactgggacgccagggacaattttcagcggcggaggtccgcgataaaaatggccgtactatcgcctcatggcgctatgatgcgcgagccgcagacgataagctcattggcttaattagccactggctttttccattgccggtatcacaacccgtctggcacaacggcagggccatcggcgaagtacggcttgtcgcccgcgacagccttattggtcattttatctggctatcgctggcagtgctgacaggatgtattctgctggcatccggcattgccctgctgctcacgcgttatttacacaatggcgttgtggatgcgctgcaaaatattactgaagttgtacacgacgttcgcactaaccgaaatttttcacgccgggtacctgatgagcgtattgcggaatttcacctgtttgcgcaggatttcaatagccttctggatgagatggaagaatggcagctacggcttcaggctaaaaatgcccagttactacgtaccgcgttgcacgatccgctgacggggcttgccaatcgcgcggcatttcgcagctgtattaacgcgctgatgaaggacaattccgctcgtagcagttcggcattgttatttctggatggcgataactttaaatatattaatgatacctggggacatgcggcaggcgaccgcgtacttatagaggttgccaaaagattagcggaattcggtggtagccgttatcagacttaccgactcggcggcgatgaatttgcgatggtgctttacgatgtacattcggaatatgaagtacaacgtatttgcgcagcgctatcccaggcgtttaatcgaccttttgaactgcataacggccagcgaataacgatgaccctgagtattggctttgcgctgacatgggaacatgccactgccgaaaaactacaagaactggccgatcgaaatatgtatcaggctaaacaccggcgtgcggagcgctcgctaaactaaggaacgggcctggccgtttctgactcagcgttgagaccactgacccagcctaatcatgcaaccatctatggcgtggagcaaacccataaaaaaggggccagcgtaatgccagccccttcttttctacaagctttcggatgttgcgaaagcgcgttcttagttaagacgctctttgatacgagccgctttaccagtacgctcacgcaggtagtacagtttagctttacgaacagcaccacgacgtttaacagcaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgtttcttggtaccttcaacaacccatactttcacttccacggtatcgcccggacggaaggaaggtacgttctgcttcatctgctcttgttcaagttgcttaataatgttgctcataatttaatctcttatcctgggtaaactgatattcgggggcctatgccatcccatcatgtttatgctgctgttgtgcgtgttctgttttgaactccgccagcaaccttgcttgctcttcagtcagagccaggttttccagaagttcaggtcttctaagccaggttcggcccagcgactgtttcaaacgccagcgacgtatctcagcatggtttcccgacagcaatactggcggtacttccatcccctctaacacttcagggcgcgtatagtgcggacaatccagcaacccatcagcaaacgaatcttcgattgctgatgcctcatgccccagaacccccggtataaaccgggcgacggagtcaatcagcgtcattgccggtagttcgccaccgctgagaacgtaatcgccaattgaccattcttcgtcaatttcggtctgaattacgcgctcatctacgccttcgtagcgaccacacaccagaataagcttctgattcgtggccagctcgctaacgcccgcttgatcaagcttgcgtccctgaggcgacagataaatcactttagcgccttcacctgccgcggcttttgctgcgtgaatggcgtcccgcaagggttgcaccatcattaacatccccggtccgccgccgtaaggacggtcgtccacggtacggtgccggtcatgcgcgaagtcgcgaggactccagctttggatgttcagcaggcctttttttactgcccggccagttaccccgtaatcggtaattgcgcggaacatttcaggaaacaggctaactatgccaataaacacaagccaatccccataacgccatttattaccgtttattcggtggtttaaaaaccaggatcccagtctacttcgatagtacgagtagcgagatcgactttcttgataacctgcccatcgaggaacggtactagtcgttccttgataccaaatgcatctttcaggttcgccttaatgacgagaacgtcattcgacccggtttccatcatgtcgataactttaccgagatcgtagccttcagcggtgactacctggcagcccatcaggtctttccagtagtagtctccctcctcaagcgcaggaagttgcgaggaatccacgacaatttcgcaattggtcagaagattcgcggcatctcgatcgtcaacgcctttcagcttgatgatcagatcctgattgtggtgcttccagctttccagctgtacctgctgccactgacccgccttctggataaaccagggctgatagtcaaaaatgctttcggcgtcttcagtggaggaaaacactctgagccaaccacggataccgtatgaagaacccattttccccagtacaaccggttcagcgggtacttgtgcggcgagttgcttgctcatcatgaccaccgtgacagattaagctgctttttttacttctttgatcagcgccgcaacgcgatcggaaatggttgcgccctggccaacccagtgagcgatgcgatccagatccaggcgggtgccttcttctttttcgctagcgattgggttgaagaaaccaacgcgctcaatgaagcgaccgttgcgtgcattacggctgtcggtgacaacaacctggtagaacggacgctttttagcgccgtgacgagctaaacgaatagttaccataacatcctcttgtgtgaataaaacaaccgggccccatcgaggaacggagcccggcgtcatattaaaagcccgaaaattttactgatttctgggaaaaaagcaatcaacatgtgatgaagcttgattccagggcgtgaccgttgcagccagtttggcgtcggcgtgcgcgcagaaagcggagcgtacacgcagtacgtgagcatttactcgctccgctcgcccttcgggccgccctaaagggcgttcaaaacactatcgtgttttgtcgagcacactccggcgtcaaaatggcaaataaggtagcccgatatatttatctacccgggaagcctggcggcatcatccccttcatactccgcatcatcttcgccatcccgcccttcttcatcttcttcatcatgcgctgcatgtcgtcgaactgtttcagaaggcggttaacgtcctgcacctgcatcccacagccctgcgcgatacgacgcttgcgggaacctttgatgatttccggcttcgcgcgttctttcagcgtcatcgaattgatgatcgcctccatacgcaccagcaccttgtcatccatctgcgatttaacgttgtccggaatctgccccatgcccggtaatttgcccatcagactggccataccgcccatgtttttcatctgtttgagctgttccaggaagtcgttcaggtcgaaaccgtcgcctttcttcagtttggtcgccagcttctcagcctgtgcgcggtcaactttgctttcgatatcttcgataagagacagtacgtcgcccatgccgagaatacgcgaggcgatacgatccggatggaatggctccagcgcgtcggttttctcgccgacaccgaggaatttaatcggcttgccggtgatatgacgaatagagagcgccgcaccgccacgcgcatcaccatcaactttggtcagcaccacgccggttaacggcagcgcttcgttaaaggcttttgcggtattcgccgcatcctgaccggtcatcgcatcgacgacaaacagcgtttctactggcttgatagaagcgtggacctgtttgatttcgtccatcatcgcttcgtcaacatgcagacgaccggcggtatccaccagcagcacgtcgtagaatttgagcttcgcttctttcagcgcggcgttgacgatatcaaccggtttctggccgacatcagacgggaagaaatccacgccaacctgctcagccagcgtttcgagctgtttgatcgccgccgggcgatagacgtcggcagagacgaccagcactttcttcttgtgcttctcgcgcaagaatttacccaacttaccgacgctggtggttttacccgccccctgcagacccgccatcaatactacggctggcggctgcgcagctaaattcagcgtctggttctcttcgcccatcgccgcaaccagttcgctacggacaatcttgacgaactcctgccctggggtcaggctcttgttaacttcatgaccaaccgctttctcttttacgcgattgatgaactcacgcactaccggcagcgcaacgtcagcctccagcagcgccatgcgcacttcgcgcagcgtctctttaacgttgtcttcagtaaggcgcccacggccactgatattgcgcagcgtgcgcgacaaacgatcggttaaattatcaaacattgtctctcgcctggggtggaaacggttggtcgccgcagcgacacagttacagaatttcgccacagtataccatgaagccgtctttgttgttatgcaacggttggagctgcggtcacgtaacgctatactgcttctctttctcactggtcaactgtcgacacaactatgcccgtttttgctttacttgcccttgtcgcctactccttcagcctcgcgctgatcgttcccggactgttgcaaaaaaacagcggctggcggcgtatggctattctttctgcggtcatcgcgctggtgtgccatgctgtcgcgctggaatcgcgtattctgcccggcggcgacagtggacaaaacctgagcctgctgaatgtcggttcgctggtcagcctgatgatctgcacggtgatgaccattgtcgcgtcgcgtaatcgcggctggctacttctgcctattgtctatgcttttgcgctgattaacctggccttcgccacgttcatgcctaatgaatatattacgcatctggaagcgaccccaggcatgatggtgcacatcggtctgtcgcttttctcttacgcgacgctgataatcgccgctctgtatgcgctacagctggcgtggatcgactatcagttgaagaacaaaaagctggcgtttagtaatgaaatgccgccattgatgagcattgagcgcaaaatgtttcatatcacgcagattggcgtcgtactgctgacccttactctgtgtaccggcctgttttacatgcataacctgttcagtactgaaaatattgataaagccgtgctctctatcgtggcatggtttgtctatatcgttctgctgtgggggcattaccatgaaggctggcggggtcggcgggtcgtgtggtttaacgtcgcaggcgcgggtattctgacgctggcctattttggtagccgcatattacagcaatttgtaagctaagcttttaaaggagtttcccctggaacacatctccaccaccacgctgattatcatattaatcatcatggtggtcatctcggcctatttttccggttccgaaactggaatgatgacgctaaaccgttaccgtttacgccatatggcgaagcaaggtaatcgctcggcaaaacgggtagaaaaattattgcgtaaacccgatcgactgataagcctggtgctgatcggcaataacctggtcaacattcttgcctcggcgctcggcacgattgtgggtatgcggctttacggcgacgccggcgtggctatcgccaccggggtactgacgtttgtcgtgttagtttttgctgaagtcctgcccaaaactatcgccgcgctctatccggaaaaagtggcctatcccagcagcttcctgctggcgccgttacagatactgatgatgccgctggtgtggttacttaacaccatcacccgcctgctgatgcgtctgatgggaattaaaacggacatcgtggtcagcgggtcgttaagcaaagaggaattacgcactatcgtgcatgaatcccgttcgcaaatctctcgccgcaatcaggatatgctgctgtcggttctcgatctggaaaaggtcagcgtggatgacatcatggtgccgcgtaatgaaattatcgggatcgatatcaatgacgactggaagtctatcgagcggcagctcacccactcgccgcacggacgcattgtgctctatcgcgattcgctggatgacgccatcagtatgctgcgcgtgcgtgaagcctggcggttaatggccgagaaaaaagagttcaccaaagagatgatgctgcgcgccgccgatgaaatctattacgtcccggaaggtacgccgctcagtacgcaactgattaaatttcagcgcaataaaaagaaagtcggactggtcgtcaacgaatatggcgatatccaggggctggtcaccgtggaagatattctcgaggagatcgttggcgacttcaccacatcgatgtcgccgacactggcggaagaggtcacgccgcaaaacgacggttcggtcattattgacggtaccgccaacgtccgggaaatcaataaagcgtttaactggcacctgccggaagatgacgcgcgcaccgtcaacggggtgattctggaggcgctggaggaaattccggttgctggcacgcgcgtgcgcattgagcagtacgatatagatattctcgatgtacaggaaaatatgattaagcaggtaaaggttgtaccggtaaaaccgctgcgcgagagtgtggcggagtaacacaatggcgaactccggttcgccttttttatcgccgtcttttaagattccatcaattcctgccatttacttaacaatgcaataatgtcttttcaggcattcagaaaggatattgatgttatgtcagaagattatgtaattgaatgggataagaattttgcagacgacctcaacgtcgtcgccaacgtttttttatcacacaacccaaccttatggcccactattttctctcaactttcgacgcaacctgaaatctttgaagacgaagatgaagacgaatatgggttgcaggacgtcctggattgtagcggtggcgatctcggaaataacgagctggcacaggcatttttacaagttctacgcggcgaaggatttattcacctcgttgactggaaaggtgaagatgaagaaggcgaactggctaattttgccgcagatcgcttttatgaactcacaaaaaacctgacggattctgaggaattaagaaatcttcttgtcgaaataacccaagaggatgaaatctccgatgtctgtgaagccggggaccgttaccttgacgagatctttgaacgcatccagaccgaactcaataagaggggcttccagatttttgatctgaatgaaggatctgacacctataatgtggtcgttctgccaatgagcgaatataaaaaaatagaggacttcaacacgccgtggctggaagtgcaggattttttaagctaaaaaaatggccgactttacatcggccatcaaacttttacttcgccttcgctacagtcaccatcgccgcgcgaatggtacgaccgttcagcgtatagcctttctgcataatacccagcacattgcctgccggaacctcttccgactccaccatcgcaatcgcctgatgcacgttcgggtccagcggcacgttggtctcagcaatcacttccacgccgaatttacgcaccacatccagcatagacttcagcgtcagctcaatcccttcgaccattgccgccatatccggattggctttgtctgcgacttccagcgcgcgatccaggctatcgatgaccggcagcaattcgttgacgaacttctcgagagcgaatttatgcgctttttcgatatcctgttcagtacgacggcgcaggttttccatttccgctttgatgcgcaacacggtgtcgcgttcgcgagtctgggcttctgcaagctgaacttccagattcgcaattttttcatcgcgcggatccacctgctcagcagaatcgtttggttcaactgcctcaacctcttcgtgctgatccatgataatttcttccggggcttgcccctcaggcgttttctgttctttactactcatgaatttctccgcgtttttttcgcattcatctcgctaacttcgcttattatggggatcagattcagggtttcaagggaagtactcacattgtcatcaatcttcgctacaaggacctcagaaaaatgaataatcatttcaagtgtatcggcattgtggggcatccgcgtcatcccaccgcactcacgacacatgaaatgctctaccgttggctatgcgatcagggttatgaggtcattgtggagcaacaaatcgcccacgaattacagctaaaaaatgtgccaaccggcacgctggcggaaattggtcaacaggcggatctggcggtagttgtgggcggcgacggcaatatgcttggcgcagcgcgtacgctggcgcgttatgacatcaatgtgattggcattaaccgcggtaatcttggcttcctgaccgatctcgatccggacaacgccctgcaacaattatctgatgtgctggaagggcgctatatctccgaaaaacgttttctgctggaagcgcaggtctgccaacaggaccgccagaagcgtatcagcacagccattaatgaagtggtgctgcatccgggaaaagtggcgcatatgatcgaattcgaggtttatattgatgaaaccttcgctttttcacagcgatctgatggtctgatcatttctacgccgaccggctccaccgcctattcgctctccgcaggcggccctattctgaccccttcactggatgccatcaccctggtgccgatgttcccgcataccttgtcggcacgcccgttagtcattaacagcagtagcacgattcgtctgcgtttttcgcatcgccgtagcgatctggaaattagctgcgacagtcagatagcgctgcctattcaggaaggagaagatgtgctgattcgccgctgcgactaccatctcaacctgatacatcccaaagactatagctatttcaatacattaagcacaaaactcggctggtcaaaaaaattattctaattttacgttagcctctttactgtataaaaaaccagtttatactgtatttaattacagtcatggtttttcatacaggaaaacagctatgttggcgcaactgaccatcagcaattttgctatcgttcgtgagcttgagatcgattttcagagcggaatgaccgtcattactggtgaaaccggcgcgggtaaatctattgcgattgatgccctgggtctgtgtctgggcggtcgcgctgaggccgatatggtccgtaccggagcgacccgcgccgatttgtgtgcccgctttgcgctgaaagacacgcctgcggcattgcgctggctggaagaaaaccagcttgaagaaggtcgcgaatgcttacttcgccgcgttatcagcagcgatggccgctcacggggctttattaacggcaccgctgtgcccctgtctcaattgcgcgagctcggtcagttgctgattcaaattcacggccaacatgcgcaccagcagcttaccaaacccgaacagcaaaaatcgctgctggatagctatgccaacgaagccgctttagcgcagcagatggctgctcgctaccaattatggcatcaaagctgccgcgatctcgcccatcaccagcaacaaagccaggaacgcgccgcgcgcgcggaactgctgcaatatcagttaaaagagttgaacgactttaatccgcaggccggcgaattcgagcaaattgacgaagagtacaaacggctggccaacagcgggcagttgcttacgaccagccagaacgctctggcgctactcgcggacggcgaagacgttaacctgcaaagccagttatatagcgcaaaacaactggttagcgagctggtaggtatggacagcaagctttccggcatcctggatatgctggaagaagccactatccaactcaccgaagccagcgatgaattacgccactattgcgagcgtctggatttagaccccaatcgcctgtttgagcttgaacagcgcatcgctaaacaaatttcgctggcgcgaaaacatcacgtcagcccggaagcgctgccgcagctttatcagtcactgctcgaagaacagcagcagctcgacgatcaggccgattcgctggaaacgctaacgctggcggttaataagcatcaccaacaagcgctggaaacggcgcaagcgctgcatcaacagcgtcagttttacgcccaggagctggggcagttgatcactgaaagtatgcatttactttcgatgccgcacggtctgtttactatcgacgtgaaatttgatgagcatcatctgagcaacgacggcgccgatcgcgtggagtttaaagtgacgacaaacccaggtcagccgctgcagcctatcgctaaagtcgcgtctggcggtgaactgtcgcgcattgcgctggctattcaggtgattaccgcgcgcaaaatggaaacgccagcgctgatttttgacgaggtcgatgttggcatcagcggcccaaccgccgccgtggtcggtaaactcctgcgtcagcttggcgaatccactcaggtgatgtgcgtcactcacctgccacaggtagccgggtgcggtcaccagcacttctttgtcagtaaagaaacagacggggcaatgaccgaaacccatatgcaacctttggataaacgtgcgcgtttacaggaactggcccgcctgttgggaggaagtgaagttacgcgtaatacgctggcaaacgcaaaagaactgctggcggcgtaaacttttttatctcccgaaggtctgagttcacaacaaaaacgccgtaagacccgacagcaaaaggttttaaagtgatgaaaggtctattatcatcggcatattaatatgagccacgtactgctcaggcccgaaaaggaacccaatcactatgcgctgtaaaacgctgactgctgccgcagcagtactcctgatgttgaccgcaggctgttccactctggagcgagtggtttaccgacctgacatcaatcaggggaactatcttacacctacggatgtcgccaaagtgcgtgttggtatgacgcaacaacaggttgcgtatgctttaggcacgccgatgatgaccgatccttttggtacgaacacctggttttatgtcttccgccagcagccaggacatgagaacgtgacgcagcagactctgacgctcacctttaacagcagcggcgtgttaaccaatattgataacaaaccggcgttgacgaagtaattttgtgataccgcctgatgaggttacgttcatcaggcctgcaaacctctcccccgccatttggtacgaatttgcctgatggcgctacgtttatctggcttacaggcacgcctgtgcttcaggtgtggtacggctttcacaccgttatccggcaaaagaggctaattatctaccagccgatttttcggcgcgctggcggcgtaatgcttttggatcggcgattaagggacggtaaatttcaacccgatcgccatcctgcaccgtatcggtgagttttaccggacgactgtagatacctactttatttttcgccagatcgatatccgtgcgcaattccagcaagccggaagcgcgaatcgcctcttcgaccgtcgcgccctcctccagcgttacgcgctgcaaatactgcttttccggcagcgcataagccacttcaaccacaagtttatccggcacggtaaacctctttggcgcgaaccgtaaacgcctgcaccatgttggacgctaactctttgaatatacgaccaaacgccagctcaatgagtttattggtaaactcaaaatcaagctgaaactcaatacggcacgcctcggggctgagcggggtaaatttccagccgccgatcagctttttaaaggggccatccaccagatgcatcagaatgctctggttacgcgttagctgattacgcgtcgtaaacgtcttgctgatacccgccttcgacacgtcaacagccgccgtcatctgtgctggcgatgactccaggacgcgactaccaacacacccaggcaaaaactggggatacgattgcacgtcattcactaactgatacatctgttccgcactgtaggggactaaagcagtccgactaatctgaggcatagcaattcccatcaacataaatcgtgtaaataataccacttatcagcgagtaaaaaaaatgctgtccccaaccgtcatgccttaattgtgcgtgcatagcccaactcatgctaagatagatttttgcacctcatcaggacgtaatggggtgttttcgatatcagattacctatgaattcacgacacttatgacgaagaaaaaagcacataaaccgggctcagccaccatcgcgctgaataagcgcgcccggcacgaatactttatcgaagaagagttcgaggctggtctcgccctgcaaggctgggaagtaaaatctctgcgcgcaggaaaagccaatatcggcgacagttacgttatcctcaaagatggcgaggcctggctgtttggcgcaaactttacgccgatggcggtcgcctcgacacatgttgtatgcgacccaacccgaacccgcaaactgttgttaaatcagcgtgagcttgattcgctgtatggccgtattaatcgtgaaggttatactgtcgtcgcgctttctctgtactggaaaaatgcctggtgcaaagtgaagatcggcgtggcgaaaggtaaaaaacaacatgataaacgttccgatcttaaagaacgtgagtggcaactggataaagcacgcattatgaaaaatgcaggccgataatagacattttttgtgaccagcttctcagtatgaagctggtcaatgttcatatctcatgcatgcctcgaaaatatattctctgtgtctgacgcttatcaatagcaataaataccacaacaagaatatattctttgtttaaaaatttttatagtctaataacacaatacttcaaatgatttttataaaatttaatattgctgaataccttcacaaaaagtattgtttttatgttaaaagagaaaaagaagaaaaaattaaaattcattataaaacataaagataaataaaaaattatcatgtattgttagcccaccctacatctccttaacacaaactccgttatatttcagacgcactaacacctttatcaatagatcttaatttgcagaaagatttttttctgactatatcatctaatacgaaagcactagtcaggcacaaaaaacaaagggttattcggcgagaaaaccagacctccacctacgctcataaaaaagaatatggctacggaaattcatctctcacgatgaacgggaaggctcgtctacgcattttgccctgaacgttgtgcccgttaattaatacacagagcaaatccatcaggagctgatttatgcgtctactcgccgtggtttcgaaattgactggcgtctccaccactgtggaatcctcagcggtcactcttaacgccccgtcaattgttaaattatcagtggcccgggaggaaattagtcaacttacgcgcattaatcaggatctggtggtgaggctccattccggcgaaacgatcacgattaaaaacttttacgttaccaacgatctgggcgcaagccagttagtactggcggaaaacgatggcacgttatggtgggtagaaaatccgcaagccgggctacattttgaacaaatcgctgatattaatgagctgctggtcacttctggcgcttcccatgaagcaggcggcgccgtttggccgtgggtactggctggcgcggtggcggctggcggcattgccgctatcgcgtcttccggcggcggcgattcccaccatcattcggatggcgataatccgccccccgataacaccaatcctgacggtaatccccctgataacagcaatcccggcggcagtacccccaacggcaatactccaggtagcagtaatcctgtagatactaccccgcctctcgctcccggcgaattattgatttcagcggacggaaaaacggtaagcgggcaagccgaagcgggcagtaccattaccatcaaagatccctcaggcaacgtcgttggcgagggcaaagcggatagcgacggtaaatttagtattgatctgacagcgccacagattagcggcgaacaacttaccgtgaccgcgactgacgatgccggcaataccggcccatcggcaaccattgatgcgcccaacattcctctccccgatacaccggttatcaccgccgctatcgatgatgccgctcccctcaccggcacgctgagcaataatcagtttacgaacgacaatacccccactctggagggcaccggcagcgcaggcacagtcatccatatttacgccaatggtcaggaaataggctcaacaacggttgataccagcggaaactggcattttgccattaccagcgcgctagcggatggggaaaatcatttcaccgccattgcgactaacgtgaaaggcgaaagtagcgaatcagcccgctttacgctgactatcgacacactcatccccgatgccccacgtgttgaactgattgccgataacaccggtttgctcaccgggccgctacagaataatgaccgaactgacgaggcaaaaccgctattttccgggcagggagacgcaggcaataccatcacgattaaagaaggttcaaccgttatcggcagcgctaccgtagacgaaaatggacgctggacctttacgccgactacgccgttaagcgatggcgaacatacctttaccgtcgaacaaagcgacaaagccggaaacacgagccgcgtgacgacaacgcctactatcattgtggacaccacgccgcctgacgccgctatcattgataatgttgcgaaagacggcacaaccgttagcggcaccgctgaagctggcagtactgtgtcgatctatgacccggcgggaaattacctgggctccacgattaccggagaaaataaccacttcagcatcacgctgaatccggctcagacccacggcgagcgtctggaagcgcgtattcaggacgccgtcggtaacatcggccccgccacggagtttaccgcttctgactcacagtatcctgcccagccgactatccttaccgtgacggatgacgctggcgccgttaccgggctgctgaaaaatggcgatgccacagatgataaccgcccaaccctcagcggtactgctgaaccaggcagtacgatatcgattaacgataatggctttcctgtagcgacctttccgcccattgtcgctgacgctgacggcaaatggagctttaccccctcgctggcgcttgccgatggcgaccatgtctttaccgctaccgcgaccaacgatcgcggcaccagcgggcagtccgtctcctttaccattgatatcgacacgcagccgccggtgctggaaggcctggcggttagcgacgtcggcgacagactcaccggcactacggaagctggcagtactgtggttatcaaagacagcctgggaaatacgctcgggagtggaacggcaggcgacgacggtaccttctcaataggtattagcccggcgaaaattaacggcgaaacattaagcattagcgttaccgataaagccgcgaatagcggtccggtagaaacgctgaacgcgccggataaaactgcgcctgcggcaccggacggtcttaccgtggcgaccgacggtctgtccgtaagcggtcaggcggaagccggggcaacggtcactatccgcgacagtagcaacaccgtacttggcagcgccgtcgctaatggcaacggacaatttatcgttccgctgaatacggcgcagactaacggccaggcacttatcgctaccgccaccgatgtcgcgaaaaacgaaagcgccgccgcgacggttatcgcgccggacagtaccgcgccagaaatgccgaaaaacgtggtaattagtgaggatggcaccagtatcagcggcaccgccgaaccgggtagcgccatcacgatcgccacgccggacggcaagccgcttggcagcggcaaagcagatggcgaaggtcattttacccttcccctcgtccccgcacagaccaacggcgaacaggttaccgtcaccgccaccgacagcgccaacaacgtcagcccgccaaccacagcgcaagcgcccgatatcaccgccccggataagcccattatcactcaggtactggacgatgttgaaagcttcaccgggccgctggttaacggacaaaccaccaacgacaaccgtcccacccttagcggtacggcggaggccggcgcgcgtgtcgaagtctttgataacggcttttcactgggactcgccacgctacagcccaacggtgcctggacgtttacgccgtcgcaaaatttaggtgaaggcgcgcatcgactgaccgtaatcgcaaccgacgctaaaggcaatgccagtcaggccgcgtcattcgacctggtggtcgatacgcaatcgccgcagcaaccggtaatcaccttcattacagatgatgcgccgggtattctcggtagcgtcgcgcatctggggctcactaacgacagcacgccaacgattaatggtacaggtgaaccgggttccacagtacacctgtatcagaatggcgcccggatagcagatattatcgtcggtaattccggcgtctggagctacgcttacaccacggcctcgccactggcggacgacacctacacctttaccgtgacggccagcgacagtaacggcaacaccacgcctttttcgaccgattttacgattaccattgatacccaggcccctgccgcccccggcgttatcggcgtagctgacggcgacggaaatacgattgataccaatcagattacccaggaatcccagccccggttgagcggtagcggcaccgcaggcgacacaatcatcctttacgataatggcaatgccataggtcaggcgctggtcggcacggacgggcgctggcagtttacgccgcctgccgcgctgggcgacggcgaccaccttctgaccgctcgcgccaacgatccggcggggaacgaaagtcccgaatccatcagctttaccctacgcatcgatacccaggcgccggatgcgccgcagatcgtgtcagccgccatcaccggcggagaaggcgaggtgctactggcaaacggcagtattaccaatcagcgtatgccgaccctcagcggcaccggcgaacccggcaccatcatcaccctgtacaataacggcgtagaactggctaccgtccaggtcaatccacagggtagctggacctatccgctaacccgtaatctgagcgaagggttaaacatcctgacggccaccgccacggatgccgcaggcaatagtagcccgacctccggcgttttctccgttacccttgatacccagcctccagcgcagcctgacgcgccgctaatcagcgataacgtcgcgccggttattggcaacatcggcaataatggcgcaacgaacgataccacgccgaccttcagcggcacgggagagatcggcagcacgataattctctacaataatggcagtgaaattggtcgcacaacggtaggcgataacggtagctggaactttacgcctgcggcactgacgccagaaacctataccattaccgtcacggaaaccgatagagcgggcaatatcagtccaccttccgcctcagtcacttttacgctagacaccactgcgcccgccaatccggttatcacttttgccgaagataacgtcggcgaagtccaggatactattgtcagcggcgcaaccactgacgacaatacaccggtcattcacggcactggcgacatcggcagcattattacgctctataatggcagcagcgttttaggcgtagtcaccgtcgatgagaccggcacctggacgctgccggtgaccagcgcgttgccggatggcgtctacaccctgactgccattgccgccgatgccgccggaaacagcagcggcgtatcgaacagctttaccttcaccgtcgacaccgttccgttgcagccgcccgtcgtcaatgaaatccttgacgatgttgcaccagtgaccgggccattaaccgatggcgcctttactaacgatcggacgctgactattaacggcagcggcgaaaacggcagcaccgtcacgatttacgacaatggcgtggcaatagggacggcgctcgtcaccgacggggtctggacattcaatacgcccgaattatcagaagccagccatgcgctaaccttcagcgcgactgacgatgctggaaataccacggcgcaaacccagccgatcactattaccgtggatatcaccgccccgcccgcgccaacagtccagacggtggatgacgatggcacgcgcgtcgccggaattgccgacccttacgctaccgttgaaattcatcatatcgatggcaccctggtcggcagcgctgtcgctaatggcaccggtgaattcgtcgttacgctcagtccggcgcaaaccgatggcggtacgctgacggcaattgctatcgatcgcgcggggaataacggcccggctacgaattttcccgcttccgacagcggtctgcccgccgtcccggccatcacggcgattgaagatgatgtcgggagcgtacaggggaatattgcggcgggcggcgccacggacgacaccacgccgacgctgcgcggcaccacggatatcggctctaccgttgaagttttcattgatggcgattcggcaggctttgccaccgttgacgccagcgggaactggatctttgagatcgcgacgccattaagcgaaagcacacattacttcaccgtccaggcaaccaatgcgaatggcccgggcggcctgtccgcaccggtcgggatcactgtcgatcttagcgcgccggcgcaaccggttattaccagcgcaacggatgatgtccccggcatgaccggtacgctggataacggcgcgctcaccaatgattcacgcccgacgctcaacggaacgggagaagctggcgccacgatccgcattctggataacggcgtagaaatcggttccgccacggtagatcaaagcggcaactggcgcttcaccccgaacgcgccgctggagagcaacgcgcacatctttaccgccgtagcgaccgatcccgccggcaatagcggccagccttcggacggctttacgctgaacattgacgcgcaggcgccagatgtgccggttatcacctccgtgattgacgataacaatcaaccgaccgttccggtgttaccggggcaatccaccgacgatcggcagccaatactgaacggaactggcgaacctggcgcgacaatcaccatttttgataacggtacgccgcttggcacggctcaggtaggcgaaaacggtagctggaccttcccggtgccccgcaatttgtcagagggaagccataatctgacggttagcgctaccgatccggcgggcaataccagcgcggtctccgcgccgtggacgatcgtggtcgatattacgcctccggcgatcccggttctcacctccgtcgtggatgaccagcccggaattaccggcaacctggttagcgggcagctaacgaacgatgcgacgcccaccctgaacgggcgcggagaggcaggcgcgacgattaatgtctatcttgacggtaatcccgcgtccatcggtaccacgacggtgaatagcgacggcacgtggagtttcacgccgcagacgccgcttgcaaacggtagccacacgttcacccttagcgccaccgatccggcgggtaatagcagcgcggtgtccagcggatttgtgctgacgattgacgccacaccgcccgccgcgccggttatcgccagcgtggcagacaatacggcgccggtaacgggcatcgtccccaacggcggctcgacgaacgaaacccgaccaacactctcgggtaccggtgaggcgggtacaaccatctcgatttataatggcagcgcgctggtcggcacggcgcaagttcaggccaacggtagctggagctttacaccgtctacctcgctgggcgcgggcgtctggaacctgacggcgacagcaaccgatgcggcaggcaataccagcgccgcgtccgaaatacgctcgtttactattgataccacggctcccgccgcgcctgttattgatacggtctacgacggtacgggccccattaccggcaatctgagttcaggacagatcacagacgaggcgcgccctgtcattagcggcacccgtgaaaccaacacaactattcgtctctacgataacggcacgctgctggctgaaattcccgccgacaatagcagtagctggcgctacacgcccgacgcctcgctggcgacgggcaaccatgtaattaccgtcattgccgttgatgccgcaggcaacgccagccccgtttcggacagcgttaatttcgtcgtcgatactacgccgccgctgacgccggtaatcacatcagtcagtgacgatcaggcgccaggcctcggcacgatcgcgaacggccaaaataccaacgatcctacgccaaccttcagcggcaccgcagaagccggcgccacgatcacgctctatgaaaatggtacggtcattggcacgacaacggctcagcctgacggcgcgtggagcgtctccacctcaacgctggcaagcggaacgcacgtcatcaccgccgtcgccaccgatgccgcaggaaacagcagcccgaacagtacggctttcaccctgacggtcgataccaccgcgccgcaaacgccaatcctgacgtccgtggtggatgacgtcgcgggtggggtcacaggaaatctcgctaatggtcagataaccaatgataaccgccccacgctgaacggcactgccgaagcgggcagcgtggtcagtatctatgatggcgacactctgcttggcgtcacctcggctaacgcgagcggcgcgtggagcttcacgccgacgacagggttaaacgacggcacgcgcacattaacagtgaccgccaccgacccggcaggcaacgttagcccggccaccagcggttttactatcgtggtcgatacccttgcgccaacggttccgcttataaccagcatcgttgatgatgtcccgaacaacaccggtgccattggcaatggacaatcgaccaacgacacacagccgacgctcaacggtactgcggaagccaacagcgcggtaagcatcttcgataatggcgcgctggtcgcgaccgtgaacgccaatgccagcggcaactggagctggacgccaaccgccgcgctcggccagggaagtcacgcctatagcgttagcgccgccgatgcggctggcaacgttagcgccgcttcgccatcgataacgattatcgtggataccattgcgcccggcgcgcccggcaacctggtcatcaatgctaccggtaatcgcgtgacgggcaccgcggaagcaggcagtacagtgacgattacctctgagactggtgtggtactgggaaccgccaccgccgacggtacaggcagcttcaccgccacactcacgcccgcgcagaccaatggtcagccgctactggcatttgcccaggataaagcaggcaacacaggcattgccgccggatttaccgcgcccgatacgcgcgtgccggaagcaccgatcatcaccaacgtagtggatgatgtgggtatttataccggcgctatcgccaacggccaggtcactaatgacgcacaacccacattgaatggtaccgctcaggcgggcgccacggtgagcatttataacaacggggcgctgctcggcaccaccacggcgaacgccagcggaaactggagctttaccccgacaggcaatttgaccgaaggcagccacgccttcaccgccaccgcgactaacgccaacggtacaggcagcgtctccaccgccgcgacggtgattgtcgatacgctggcgcccggtacgccgtcaggtacgctcagcgccgatggcggttcactttccgggctggcagaggcaaacagcaccgtaaccgtcacgctgacggggggcgtgacgctcaccaccaccgctggcagcaacggcgcatggtctctcaccttgccgacaaaacaaattgaaggtcaactcattaacgtgacggcgactgacgctgcgggtaacgcctctggcacgttaggcattaccgcgccggttctgccgctggcggcaagggataacataaccagtcttgatctgacctctaccgccgtcaccagcacgcaaaactattcggattacggcctgctgctggttggcgcgcttggcaatgtcgcctcggttttgggtaacgataccgctcaggttgagttcaccattgctgaaggtggtacgggcgacgtcaccatcgatgccgccgcaacgggaatcgtgctttcgctgctcagtactcaggagattgtggtacagcgctacgacaccagcctcggcgcctggacgacgatcgtcaacaccgccgttggcgacttcgcgaatttgcttaccctgaccgggagcggcgttaccctgaacctgagcggcctgggcgaaggccagtaccgggtactcacttataacaccagtctgctcgctaccgggtcatataccagcctggatgtcgatgtacaccagaccagcgcaggtattattagcgggccaaccatcagtaccggcaacgtcatggctgatgataccgcgccgacgggcaccacggtcaccgccatcaccaacgccaacggcgtcagtacgccggtcggcgcgggcggcgtggatatcctggggcaatacggcacgctgcacattaatcaggatggcagttacacctacacgctgactaagcccacggcgggatacggacataaagagagcttcacctacaccatcacccagaatggcgtcggtagcagcgccgcgcaactggttattaatttgggtcccgcgcctgtaccgggcagcgtgatagcgacagacaataacgcctcgctggtctttgatactcacgttagctacgtcaacaacggcccctcgacacaaagcggcgtcacggtattaagcgtcggacttggtaatgtactgaacgcgaatctgcttgatgatatgactaatccgatcatctttaacgttgaagaaggcgctacgcgaaccatgacgttacagggaaccgtcggcggcgtctcactggtttccacgttcgatctgtacgtttatcgcttcaacgatgccattcaacaatatgagcagttccgggttcaaaagggctggattaacaccctgctgttagccggacagtcccagccgctgaccctgacgttgcctggcggcgaatacttgttcgtgctgaataccgccagcggcattagcgtcctcactggctatacgttggcgatttcccaggaccacacctatgccgttgacagtatcaccgccaacaccaccggcaacgtactgaccaatgatgtcgtccctacggacgccctcctcactgaagtaaacggcgtggcgattgcggcgaccggcacaacggaggtaaacgggctgtatggctcgctcatcattgacgcaagaggcaactatacctacacgctgaagaacggcgtcggcgccgacagcattaaaacgccggacagctttatctatacggtcaaagcgccaaacggcgataccgatacggcctcgctcaatatcacgccaaccgccagggcgctggatgcgattaatgatgtcagcgataccctcagcgtcgccacgcttcaggataccgctgcctggctggactccagcgtcggcagcgccagttgggggctactcggcaaatcgggcagcgggagcggcacctttgacgttgcaacgggcaccgtacttaaaggcgcgtcactggtttttgatgtctccacgctcattacgctgggcaatctgaatattagctgggccattcaggagaacgggaccgtcatacgcaacggaaccgttccggtggcgaatatcacgctgggcagcgcgacggtgaccgttaacctgagcggcctggagctggatgccggaacgtacacgcttaactttaccggcaccaataccctggccggggcggcgacgatcacgccacgcgtcatcggcaccaccgtcgatctggataattttgaaacgtccggaacgcataccgttctcggcaatatttttgacggcagcgacgcggcgggggcgatggatcagcttaatacggtgaatacccgcctgagcattagcgggtataacggcagcgccgccacgctggacgccgcggcgaataccaccagcgccacgattcagggacattacggcacattgcaaattaaccttgatggcgcttacacctacaccctgaataatggcgtcgcgatgtcgtccatcaccagtaaagaggtctttacctatcaactggatgacaagatgggtcatacggatagcgccacattgaccattgatatggcgccacaaatcgtcagtaccaaccaaaacgatgttctcatcggctccgcctatggcgatacgctgatttaccacctgttaaacggcgcggacgcgaccggcggcaacggcgtcgatcgctggcaaaacttctctaccgcgcagggcgacaagatcgatatccacgaactgctgaccggctgggatcaccaggcggcgacgctgggtaactttgttcaggttcataccagcggcgccaatacggtgatatccgtcgatcgcgacggcaccggcagcgcgtttaaatcaaccgaccttgtcactctggagaatgtgcagctcacgctaaatgatctgttgcagaacaaccacctgataaccagcggttgataaaaaagccccgaacgccacgacgttcggggcaacaagcggtgatatttaaaagggataaactatgggaagagtcgcgcctgtcgccatcgtactggcatttgctttgtttcatcaccagccccggggcgcagaagcgccgccaatgattacatccgaaggattagcaacggaccagatgcttccttcgctggatggctccgccgctgagttgccgctcagcgccgccgcgccgggcaacctgacgctcaatgacgcggtcaatcgcgccgttaactggcatccttctattcgcgaagccatcggcaaactgctcgcacagaatgaacaaatagaggtcgccaaatcgaaatattatccgcaagtcagcgctggcgtgaacaatgggtacagcaatacctacaccgatcacgggtatagcccctcgctagtgctgtcggtatcgcaaatgctttatgacttcggcaaagtggcaagccaggttcgcgccgaaaccgcaggcgcagcgcagcaacaggccaatgtgttgctcagtattgataccgtcgcgcacgaaaccgccaacgccattgtacaaacgcagagctggcagcaaatggtagaagcggcggaagaacagctcgtcgcgctggacagcatcggtaaacttatccggcagcgcagcgatgaaggcgctacgtcgctctctgacgtggtgcaaaccgaagccagaatcgaatccgcccgctcgcaactggcgcagtatcaggccaatctcgacagtgcgaaagcctcactgatgagctggctgggctggaattcgcttaacggcatcaataatgacttcccggcgaaacttgctcgcagctgtgagacggcgactcccgacgatcgactggtgcccgcggtactggccgcctgggcgcaggccaacgttgcgcgggcgaatctggactatgccagcgcgcaaatgacgccgacgatttcgctcgaaccttctgtacaacattatcttaatgataaatatcccagtcatgaagtgctggataaaacccagtattccacctgggtaaaagttgagatgccgctttatcagggcggagggctgactgcccgacgcaacgccgccagccatgcggtagacgcggctcagtcgaccattcagcgcacccggcttgatgtccgccagaaactgatggaggcgcgcagccaggcaatgagtcttgccagcgcgttacaaatccttcgtcggcaacagcagcttagcgaacgtacgcgcgaactgtatcagcagcaataccttgacctcggttcccgcccgctgctcgacgtgcttaatgcggagcaggaagtttaccaggcgcgttttgccgaactgcaaacggaaagccagttgcatcagttgcaactgaactgtctgtataacaccggcgcgcttcgtcaggcgttcgcgttaaatcatcgcagcattcaatccgtggagatccagccatgacccgcgccgcccccgatgtagaagaggtactcagtgagcgcgcgctaagccaatgggcgcaggccatcagctatgtcgccggtcattatcgcgttgcctgttctcccggttcaattcaggccaacgccccgtggcttaggggtaaaagcagaacgaccgccttaacgcagctcgcgcggcaggcgggtttatcctttcatgcgccggacatagacaaaacggcatttagtcagtggcgattgccgttggttgtcgagctccgggacgggcagttattggtcatcgaacatgttaatggcgaagaggcggtagacgtttttgtgattgaagaagagggtcagcgtaaccgcctgacgctcagcgagttattgccggagatcctctatgttgccgcgctacgcccgctatcggcgctcaaggatagccgcgtcgaccgctatatctcccgctttaaacccgactggatgcgcgagctggttctgcaggatattcgcccttatttaccggtaatggtcgccgcctttctgattaacgtgctgtcgctggccgggattgtgttctctatgcaggtttacgatcgggtgatccccgctcagtcatatcctaccctgtacgtgctctccttcggcgtgctggtagcggtgctgttcggttttctgctgcgtgaagcgcgtacgcacattatggacgtgctcggtaaacgcgccgatatgcgcatttccgatcgggtattcggtcacgcgttaaggctgcgcaacagcgctattccccgttccaccggcagttttatctcgcagttacgcgaactagagcagatccgcgagatgattacctcttcaacgctggcgaccattgtcgatctgcctttctttttcctgtttatgatagtcctggcgattattgccccaccgctggcatggatagcgcccgtggcggctctgctgatgatcctgccgggcgtcgcactgcaaaaaaaactggctgtcctcgccaaccaggccgcccacgaagcgacgctacgcaatgcagtcttggtcgaaagcgttcaggggctggaggatattaaactgatgcaggcggagaaccgctttcttcagcagtggaatagctatatccgtattaccggcgagtcgggtctacgcacccgcaaactcacgcaagggcttatcagttgggggatgtcggtacaaagtctggtgtatgccgcagtgattatgttcggcgcgccgatggttattgaaggcagtatgactaccggcgccgtggtcgccgcgtcgatgctcggctcgcggatgatcgcgccaatggctaacctgtgcggcgtgctggcgcgctggcagcaggtgaaagcggcgaagatgggtctcgacaacattatgcaactgcccaccgagacacagcatgacgatagcctgatacaccgcgacatcctccacgggcattacctctttgaaaacgctcagtttcgttaccataacgacgatcaacgcataccgttgcgcctcgtgcgtctggagatcatgccaggcgagcggattgcgatactggggcgtaacggtgcgggtaaatccacacttttacaggcgatggcgggcggcctggagatgattcagggagatgcccggcttgataatctcagcttgtcgcacatcgatatggcggatttacgccgcaacatcggctttcttagccagaacgcgcggcttttcttcggcaccctacgagagaacctgacgctcggcgcgccgcacgccaacgatgaacagatttttgacgcgctcgaagtcagcggcggcgccgtcttcgtcaggcggctggcaaaagggttggatcatcccattatggagggtggtaacggcctgtccggcgggcagcgtcagtccctgttgctggcgagaatgctgctgcgctcccccaatattgtgctacttgacgaacccagcgcctcgctggacgagcatacggaacgagagtttattcagcggttacatcagtggcttggcaatcgaaccctggtcgtcgcgacgcaccgggtaccaatactggagctggttgagcgtgtcgttgtcctgaaagaaggacaactggtgatggatgcgccaaaagcgcaggcgcttaacgcggatcggatgcaaagtcaccgtcgggagtggaaaaatgaaaatcaatcagcatgatgccgcgatggacgatcccgatattcagcgtgaacgggcgttttccggcgcgggtcgtattgttctgatctgctcactgttatttctcattctcggcatctgggcgtggtttggccgactggatgaggtttccaccggcaacgggaaagtgatccccagttcacgcgaacaggttctgcagtcgctggatggcggcattctggcgcagttgacggtgcgggaaggcgacagagttcaggctaaccagattgtcgcccggcttgatccgacgcgtctggcgtccaatgttggtgaaagtgcggcaaaatatcgcgcttcactcgcctccagcgcacggttaaccgcggaagtcaacgacttacctctcgccttccccgctgagctgaacggctggccggatctgattgccgcagagacgcgtctctataaaagccgccgcgcgcagctggccgataccgaagccgagctacgggatgcgctggcgtcggttaataaagagctggccattacccagcggctggagaaaagcggcgcggccagtcatgttgaagtgctgcgcctgcaacgacaaaaaagcgatttaggcttaaaaattaccgatctgcgctcacaatattatgtgcaggcacgcgaagcgttatcaaaagcgaacgctgaggtcgatatgctctccgccattttaaaaggacgcgaggattccgtcacccgccttaccgtgcgttcaccggtacgcggcattgttaaaaatatccaggtcacgacgattggcggcgtgatcccgcctaacggcgagatgatggagatagtgccggtagacgatcgtctgctgattgaaacccgcctttcgccgcgtgatatcgcctttattcatcccggccaacgcgcattggttaaaattactgcttacgattacgccatttacggcgggcttgacggcgtggtggagaccatttcaccggataccattcaggataaagtgaaaccggaaattttctactatcgcgtatttatccgcacccaccaggactatctacaaaataaatcaggacgccgtttttcgattgttccaggcatgatcgccacggtagatatcaaaaccggtgaaaaaaccattgtcgactatttaatcaaaccgtttaatcgcgcgaaagaagcgctgcgcgagcggtaaatcgttgaagataagaagatacgggggctggtcacgcgtgtcacaagtctgttatacttatcttacacattggggctgattctggattcgacgggatttgcgaaacccaaggtgcatgccgaggggcggttggcctcgtaaaaagccgcaaaaaaatagtcgcaaacgacgaaacctacgctttagcagcttaataacctgcttagagccctctctccctagcctccgctcttaggacggggatcaagagaggtcaaacccaaaagagatcgcgcggatgccctgcctggggttgaagcgttaaaacgaatcaggctagtctggtagtggcgtgtccgtccgcaggtgccaggcgaatgtaaagactgactaagcatgtagtaccgaggatgtaggaatttcggacgcgggttcaactcccgccagctccaccaaataaaacaaggggttacgtgaaaacgtagcccctttttctttggtagtggcggcaaaatggcgacagcgtgtcggactggcggcaacaaaaaacccgccattaaagcgggttctgttcagaaactcatgtggccttgaccaccttttcccggatgtggtggcgcagaagaaattagattcggttttataatgtgccgtacaaacgtttcatgagtaacgaacgtacagccacaatttatattttggcactggttgtaacgttcttttgtcgtagctgatacctgaaagctgcttctggtatgtgctgcatgaccgcactctggacagttcatcattgctgttatcccaccacttttgccataatcgcaataatgatacagcattattcaatattgagaaccaatcattcaatttcaagatcatcaatctttacttcaagctccatgctggtcgtaaatccattatccgggctgacagaatgcgtcagggtggtaatggtccattctgcatcatcaatcggctgcttaaatcccgtcaccttcaccggcatttccgtatagagatcagcccgcccctcagcgagctgtagggaaaatgaagcaaccccgcgctgcaggcgttcccactgcatttttgctgcgcgctctgcattgctccggttggcgtaggtacgattaagaaccaacacgttttcatccgttcccaccagataatcaccctgttttgcttccggctctttgggtgtggtggctttctttcgacgacgcttaacactggttgtctcttttttcctgggttcacgcgtatgcaaccagctggcaataacaccggtataggcaccacgatcagcaagggtgaaccgatgaccgtcaccggctttgcgcgtgatggtgataaccggcagcggcttgccgcttgccgttcttccctgtccctgccggataaacagcaggttcccgtctttaacggaagcaatcgccccatactgtctcgccagtttcatcagaaaacttgcatcgctttcattggtctggtccatatgatccagcgccttatccgtcaggtcttgacccagcgccactttgaggttatgccgggcggcgatttcctttaccacctcccccaccgttgtctgatgccatgatttttcgcgccgtgtattgagggtttcacggaaatctgcgctacgcgccctgatggtcagccggtcaggggctccgctgtgttcaatttcatctacggtaaaagcccctttagggaaaagcggctggcctttccagcccagcgccagatgaataacagcaccacggcgcggcagaacgatctgcccgtcggcgtcgtccagctccagatcaagctggtctgcttcaaagccccggttatccgtcagtgtcagactcatcaggcgcgcgtccatcaccgtcgtcacgtctttgccttcgatggtgatactgaaagccgggcttttgctgttcagattcaggagatcagaattaaagttcactgcagcaaccctccaaccgtgtttttaatccccccaatagcagatgctgcagagtcctgcaggttgctgagctggtcactcaggctcccgaacatgtcagagagcgactcatcaacccgtttgagggtgatcgtaaactcaatgcgcctgggcattccgctggcaaaaaactccgtctttgtctggctcagactctcaataacaaacatgccgtaaatggttccactgccttcaatcaaaggccatgccttgcccagttcagccatttgttcaagcgccagtaatgacagcctgcctccggtcacttccggcagcagaaccccggacagtgtcagtgaatcattatccgggccaagaaactgcgttgacgggcggcggttcacccggctgttggcggtgtgtcgccagctgcgctgatactgcagttcctgataagggacagtgcgcagcataaatacatataaacccagcaccatcatcatgattcataccccccctgatcgctgaaattgctgcgcgcttttgccctggccctgcgttcccgctcgtcaagctggcgtgccacttcacgggcaatatcctgcgcactctgtcccggctgcgcgacgatatgaatgggcgcatttatctcataacgaataactgacggcgggctgtcagccttaactggctgcgtctggtatgtcctcgcaggcagactgaacggatgaagcggagccacttctgcaggtgtcgcagctacccccatcacgccagcaacgacagaggccagcgcagcagtacgccgcctgctggtaacatttgccggtccgttcacaatttcagggccattttctccgacaatgccaaactgcccgcgtggaatgatcccgcccgtgtcgtacatcccagcgtaagccgggaacccgcctggcggcagcaccactttgccgtcactgttcactgtggcggactgctgctgcgtaacctgcgcaggtagtttcgcctttgccgcctccttactgacaataccgagcttttccagcagccatgacacaccggatttaagtgactcaagtgggtgcatcaccatattcagaccttccgccagtgcctcaccaaaccgacgccccattgcagctgcgctgttcagttcttcggaagtggatttaaccggggtaagtaaatcattgaaccagccccacaaggcctgcaccctgtcaccaatccactgaaacacgggtctgagcggctcaaaggcagcgctgatgggcgcagcagcggctttgaacccttccaccacgccccccagaaacgcactgatgggctgccagtatttccagataaccagcgccacgcctgccagtgcagccacaaccagccctacaggactgagcagcgcacccagcaggctaccaacagcaaataatgccacgcgcagcaaagccagcggaccagagatcaacaaacgcagcacgctacctgtacgtgtggcagcggcggctgcagaaggtaacgctttaactgacagcatggacaggccaaaccggataaccgccagcggtcccagcacagcagccaccgccactgccagcgcccccaatccaacagtgatggctgccgtagctgccgccactttcatcagcgtgccagccagcacgggattctgctcaacccagcgacgcaacgccccggtcacgcgcttaaccatgcccataatatccatcagcggctggcgcagcgtttcccccaggctgctgaaagcgttctgcgcgcccgtcttaaccagcaaccactgtgcagacaatgaatccttgttaatgtcggattctttctgcatggagccattagcaccactacctgatgtgagtttcagctggcgctgcagctccggcaggttgttagccagctttgccgcatcatcgccaaactctttgccaaaaatcattgtcatggctgacaggcgtttatcctgcggcagattgttgaccttctccagaacccgctgaattgtgcccatggcatcggtggtcatctgcttttcaatctccgccggattgagttgcaacagattcatgccttcaaaaaatcgtttactttgcatggtggcaatggacagttcacgcaccatggcattagaggcgctggcggcgatttccggggcagccccaagagaaaggaatgttgaacccagcgccgcggcctttcggaagtcaaggcggtcagccacgccccccatacgctgcaggacgttgataatgtccccaccctttgacatggcgttatcgtccaggtagttcagcgcatcgcccagttgttcaatattgcgcgtcggaactttatagagctgcgcgattttccccagcccttctgccagttcatctgcgggcagctcaaaggccgttgccgcttttgccgccgtggatgcaaaagccagcaggtcacgtttctgctcttcgtaaggatcgtcctgattggtcacccccatgcgagcaccaccttcaaccagcgcggcatagtctatagcgccgttctccatcggcagctgttcgctggcggccttgatggcatcctgcatgtcataaaactgttttgtgcggttgccattatcgtctcgcagcccgtttacctgctttgccacgcctttcatggcatcttccatgctggcgtagctcttaactgccgccacaacaggtgcgcccattgccacccctgcagccgtagtggtagcccctgccccggcgatgcgatcccgcacctcaagacggcgcgaatactgatcgcggacggcgttcattcgcgcctgctgttcgcccaggcgtttaagggatttctgctgccggtccagggcctgccgggtttcgtcggcattctgccgcagttcccgctgcgcactactgagctttttcgtgtccagtccggcttcattgagcgcaagacgctggcgctgcactgactgacgtagaccgttatatttgctctgtaactccgtaacgcggttctttgcctgctcaagcagccgtgcctgcgccgccgtcgggcggttggtggcagagaattgcgtggcaagtttcgcagcttcttcgcgtgcggctttcaggctgttaccggtgactgccagctgcgcgctggccttgcggaaaccgtcaatgcggcccgcctgagcatctaattcttttaaacgggcgcggctttgctgaatcgctgtagccagctcttttgagctggcctgcgcggatcgaaatgggcgggtgagcttgtcaaccgcattaagaatcacctgcagacgcaggttattgtcactcatcgctggccccgcttcgctgaattgccttataccgccacgccagcacctcagtcagcggcataacgtcagtgatggatggcgaccagtgaaagatggtggcgatatccgccacaagatcatcaatcgtcaggctgtcggtaaaccggcaagcaccgacttcttcaacaaaaaagtcaccacctctaccgacagcgcggtgagatcggcggggtccagctctgccatttcctgcgcggtcagcgtcggggtggagattcgtgggatcacagtcatcattgcgcccacgtccatatccataatggcctgcagacgggtgccacgcagtgcgccggactgaggcttgcgcagcacaatttcggtaatttcagttttaccgcgcatgatgggagtatccagttttacggtcttttcagtcagcttgtcgctcatgttcgtatcctgttaatgaaatactggcgcggctgcccgcgccgttaaggttaatcagaggccgagggcattacggtgtgcttccatcaggtccacgccgccaacgatttctaccatgttgaccagatcgacctcatagagcacctcaccattaatggtcagcttcgcgtagctgttggtactgctgactttggtgctgctgctctcgccggttttccactcgccggaatccacttctttatggcgcccgcgcacaaccagctcaacggcctgcacttcgccggtatcgtcacgctgaatggaaccggtgaaacgcagctggatgccgtcaacggttgccttgcccatctgcttgaataacagcagctcggtaccgccgattgaaaattccgtgtccagtgcaccgtcatccagccccatgtccacatccactgcgcccggcataccgccgccgcgatacttctcaaacttgcgggtaaatttcggcagggtcagagactcaacgatcccctgccagttgttcccgtcgttgaacaggttcaggtgttttaacttgcgtggtaaagccatgattcccccttatgcagcgacacggctggcaaaatcgaccaggtaacgatcggtgatgcgctggcgcagcatcaggttttcaagcggaggcaccggcgtgtagtcataatcgatggtcagtttcccggctttaagggtgtctttatcgttaacagactcatccagccagcagtcaccaccaatcaggtatccctggttgaccagactgcgcatcttggcgcgtagtccttcaataatgtcgcgggccagcgacggattaagcacgccatccaccgcccacatgtgcgcctccgccatagtgtcagccagcacctgcgccgtgcgggtgtagttctcaaaggcaaacagcggatcgtcactgagacaacgggaaccccagaagcggaagccgtctttgcgaatcaatgtggtgacgtcatttttgttcagcagtcccgcatcggttgccgggtcctgcagatcccagaacacatcagcggaaatgccggtgacaccgttcacacccacattggacagggttttatgccagccgatctgctcgtcgattttggcacgcaggccgagcgcacgggcggaggcgtaagccgtcgcgtctgctttcagcacggtgtcaaagttgatgaagtcaggccagatcagcattccctcgcgctgactgaaattctcgcgataggcaatagcttcctccaccgttttgcagccattagcagcaaggtaggcaaacccgcgcaagctttgcgccacgcccagcagttcagtagcaacggcctgagtgtcatgtcccggcaccccaagaatgcgcggcttgacaccgagctgcgactgcgccgacagtagagctttcatgcccgttttcttaccgtcggaagttacgccgccgataatattggaggtggtttccgcttcggtttctccctgcgccacacgcacaacgacagtcacgggttttgcctgatctgcaatcgcgtccagcgagcgggccagcgtgccggactcccccgctttaccgctggcggtgagcacatcagtcagcaggaccggcttattgagggggaacacggacgcatcagcatcatcgccggtgcagaccatgcccacgatggcagtgctcaccgtggtaataggtcgggtgccctcgttgatttcaacaacgcgcaccccgtggtggtaatcctgagccataaggcagtctctccggttgacagggataccttatgttctggttgccaggcgtgcggcgcacgtatttcacgatgtgtcagtgctggtacaatatcgccactttcaacgcgactgatttacagggaatttcttgtaaagagtggaaatgctaacatcaaaaagcaatccaacacgatgacgagtttcaccggcggcaagcaaccgtccggcctgctcccattgctccggagtgagctttggacgcctgccaccgactcgcccttgcgccctcgcagcggcaagtccggcgcgggttctttccacaattaattccctctccatttcagcgagtgcgcccatgatatggaaaaagaaacgccccattgatgtggaagtatctatgctatccgtaagactgcggaaattaatgccacgctcccgcagctcctctaccagaacgaccagatgacgcatactgcgacccaggcgatcaagcttccatacaaccagtgtgtccccttctgataacgtcctgagcaacttttttaatccgggcctttctgatttggtcccgcttattttgtcttcaaaaatcagttcacatcctgcgcaattcagcgcgtttcgctgtaaatcagtattctggtcatttgttgacacccgtacatagccaatttgcacaacaggccccctcgcaaaaggctgggatcatgccatttacgaccgttttctgcattttcataaacctcggtttaggcgaaacagcaaagcaagctgcgggcgcagtccagaaaactggcgatgagatgagcgggaagttaaccctgccacagacatcttccttcggcgtgaatactaacaacacactgggcggtagttccatcgctatcggtgataacgataccgggctcaaagggaacggcgacggtaatctggcatttatggctaacaacgtgctggcaggatattttaatgaaaatgaattgcagcacagtaaaaagatgctgactaaaaattttcaggctcttgttgataataactggccggagggggcggggggattttctggtcagttaagcagtgaagcaccgtttagtgtaccaatggttcaccgtcagaataatgataataattttttcccgctcctgaaaggaaaggtctcactggagtctggctatcctgtagccgcctctttcggaatattaactagtgggaatactaatttcccacaaattgcaattcatgcaaaaacagactttgatgttaacgataaaatatgggtatttgatgttgcaaccggagaatttcgcgcaccgggaaggattactgctacagaaattttattgagcggtaaaagccgtgttggtcctgatggtaatttatatggtgatgtgtggggtggctggctgaatgacttccttattaataattacaaccgtaaaaatactgccagcctcggtgattatggctgggttcgtgacgaaagcaccgggtttataatgcaatgggggacacttggtagctcaaacggaacctacaatttcccgcgagagtttccgacatcctgctttgctgtatttgtcaccaacactaatcagcagggaggttcagtggataatgcgtttggatacccggtgagtaaaagccagttttttgccgcaactaaagcatcaacagacggaaatgtcgtaaatggctatcctgtagcctggtttgcgatcgggagataattatcaatgagcgattattattacagctttaaagagaaaggttttttctacaagccggataccgaatcgggcgatttcccgactgatctaattcctctgactgatgaacattaccatggacttatgcagggtcaggtggacggaaaatatattgagcacaggaaaggaggcccggtactggttgagcatcgcgaatatacgcctgaagaactggttgcacaggctgaatccagaaaagcggaacttcttgctgaggcagagtcagtcattgcgccactggcgcgagcggtaaaattaaaaatggctacagatgaggaaatcaagcggctggaggcatgggaactctacagcgtactggtaaaccgggtggatacctcaaaccctgactggccggataagccagtcagccagtagtcgttattgtggtaatgcaggccacctgattgcggtgaaggtggcctcatctgaaacgtctgttaagtcaagcgatttaagaacattgatatagttcatccacaaaatcaaagccgctttattttcatcactgataattcccaacgttaattctgtgcgccagtccttaatggcattatctgcatcgttaagtaatttctgtcgggtggtttcggccttagcctgataatccaccggaacgggtaaaaccttaccatctctgtacaaccatgagccatcaccacgacaatcatcaggacagtcagcagcgtctatttccgcaacagacatattaaccggccacaacattgatacagcatatgtgtttccacgttgcgggactggatgattaacaacaccccagataaccccttcaggatcgtacataatttttgcagtatcatcagaaaataatgactgacattcataccagtcctgcccgtcttccgattccaggaaatatgcacctatatttatttcggcctgagttttacccctgcttacggggtcgtcaataagtctgaaatttttgatattctgatattttttcattatgccgttcccccttgtacggtataccactgattcccgactcgtttttgcaaaggcgcataattaataccatcaatattttcgccttgtgcatctttccagacggaggtaactacatatccgggagtgttaggccaggaacctgcattgttccaggtagtcactgatgtgccagcccctaactgaacatctgcgacgaaattattattaatccacagactcagccagctattcccccagacagaaccaaagatgtcgccgttattctgatagatggccccgcctgcacgaagcgtgttagcggtgatatcgccattgaccgtaaagacaatcgaaccatcaggatttcgctggctgtataaatgccatccctggtcgtcgtccagttcaatcactgtaggcctgtttgcgtcgccccataaattaaacgtggctgtcattgtcgaattattattactcgtcagtgacagttttttttctttgcctgcgcgaatagctcccagaaccatcatttcaccgggagcgacacgaacggtgtgctggctattcgcaaacgtatccagtatcccgtcaccattctgtttaaagccggtatcgttatcaccaatagcgatggaactaccgcccagtgtgttattagtattcacgccgaaggaagatgtctgtggcagggttaacttcccgctcatctcatcgccagttttctggactgcgcccgcagcttgctttgctgtttcgcctaaaccgaggtatgtgagaaggccggcgatatcttttccgcttaaattcgtcagtgtattgtccagcggttgctttccagccagagcgtttatcatcgtcgtggcaaagttcgggtcattccccagagccgctgccagctcgttcagcgtatccagtgctgcaggcgcagaatccaccattgccgcaatagacgatgccacaaattccgtgttcgcaatctgtttagtgctgttacccgccgctggcgtcggtacctttggaatccctgtgagtgtcgggctgtccttctgcgcatactgtgaatgcgggtccggcgcagcaagatgctttgccatcaggtcgtctacatataccttcagctccagcgccttatcatctacatatttacgggttgccagcactactgcagggtcaattttcagggtgatgttatcggtgctactggtaatcagtaccatgcgcacggtctgcgtacgtccgctcccttctgtcagctgcggcttgtagctctcagggcagttacccacggcgatcagtgcgccggtttcatcaaacaggccgacctcacgaatccaccatcccccctcagtttccgggatcacttgctcagcaataatctggctgctgttctgcgggtcgatatacagcatattcagcgctgctcgacgcttctcagcaactaacgcggtctgttgcgcgctgggtgtgggcagcacaccgccaccgtcgcccaccgccatatgggtaattttcagcgggacaccgagcgcggcggcgcttgccagtttcgccgcgccgatctccgtcagcagggtataaaattttgcgctcatggattcactctcattgtgtcaataacatggactgccccgccttcatgtgcggtgccgccggaaacaatcgtttcattgatatacggatacaccgtgatttcttcaccaaggtagctggctgcaccaacccagtaagggccgctggtctgcatattaatggacatacctgtcatgtggcggctgcatggtttggcatcgcttatcaggcgctcaagctccagataggtgtcttcggtgataccatgatcctgtacgccaatatccagacggaacgtccccggcgtttcgccggtctgccaccactcattgatgcggatcaggaagccgaacggctctaccacgcgccgcacggcgctggttgtccccttgtgctgatggatataaaaagcgtcctgcacaacgcggcgcttgacgctttctgtccagctctcatcccagcggtcaacagaaaacgcccaggccagataaggcaggaatctgatcgggcaggttgccgggttccacaaatcacgcagcgatacctgcagatcggaaatcccgctgcaggtctgcgccagtcggcgctcaagcggcgacgaacccggcggcaacagactattcatccgtgcccccgttggtaacgctccattcggtacaggatgccgcctgtgtcttatccagcaccacatcctccagaggggacgtcagctccacacgctggacgccctccacgtgcaacgcggcataaatggcgctgcggcggatatcacgtcccagccgcgtctgactggcgatgtacctctgcagactggcttttgccgccaccataacaggctccgcttccggccctggataaagaaaaatggtagcctccacccggtacggtatgatctccgcactacgaaccgtcagacggtcagccaccgggcgtacactctcactgttcagggctttttcaaccacatccagcaggtcttttactgctgtaccgtcaccctcacggctcagcacggtaagtaccacctctgcaggggccggactggttgcgctggcatctgccacacgtccgtccgcacttctggcgtgaaattcataggctcccgtagggccagcaacggacagtccctcaaatgctgcagggatgcgctggcgcagcgcctcatcatcttccatcactgcggtgaccggcggtactgcatcattatcagcaggaactaccgtcagacgtttcacgttgcagttggctgccagctgctcaagatcatttcccatcgaataggccaccatcaccgcctgcgcagcctcgttaatacgctggcgcagcaggatttcgcggtatgtgctttcctgcagcagcttggtgacgggttcagattccagcgccagcgtgcgccgcaccgcgtcctgttcatccacaggataaagagccacaaaagcggccttgcgctcagccagcagcgtctcaaaatccggcacgtccactatctgtggcggcggtaaccgggaaaggtcaatgactgccattgtctgctcctgttgatatggaaagggaaaccggtgctccgttattactatgtcccgtaagctcaaccaccatagagccgtcaaaattgccgttgatggtgatggagtccagcgtaaggcgcggctcccagcggttcagcgccacatagactgcagacataatctgcaggcgcagtgccgggttctgcggctggtcaatcagcgcgaacagcagcgaaccgtattcccgccgggcaatgcggctaccctgcggtgtcagcagaatatcccgcaccgactggcgcagatggtctgtatccgcaagggcctgcccgtcattccggctcataccgatatacagcgtcataccggacctcccgatgtatccccgcctgacttaacgccagtgtgaccgtgtttatccatcacgaccccgttagaactcattgcgccgccgccctgggtaacgccgccgttgatcaccacctcgctgttaatgcgtgttgtgtcagcctccactacaaactcaccggtttttagggtgatattgtccgccgcctcgatcaccatggatttgataccccggacatgccaccgcccggtggcgggttcgtactcaaaccatccaccgtccgggtactccgtcacgcagccgtccacagaatccgacggcggcgcaaactgattggagtagatggcaggcaacgcaaaagcagtttccagattgccgcccatgctcagtaccaccacctgctcatccggcgacgggcaccaccatgtacgggcaccaccggcacgcagcgtcagccagttaatccagttggtttcaagctcgcccactctcacccggcacagccagttttcccggtccacttcggtcacggtgccggtgcggatcaggttggtgataaggcgcataatttcggtcagttgtgcattcataacgaaaggttgccatcagagggaaaaggtaggcagcgcgggcgcttgtgccagcagtggcacaaagatcaccccgccagccagcgcagcagggtgtcgcgggtgacggtttccacttcttcattcacgcccagcaggcggcgctctgcgtagcggacctccgggccttttcggctgacgcgatcccgcaggccgtaatggtgaacacgggcaatgcgctgcaccttgccatcaaactgcacgctggcggagtccgcactggcggtggttttcaggtattttgtggtgcgaagctttgcaaacatctggcgtttgatgcgtcccttcttgctgcgggcagtcacccggcgcggctcatagccgctgccgtcaggattacgctgcagcctgatgttctgctgctgcgtccggcgcagctgttgcgccagttgccgcatcatacggctgcgcgcggcaggctccagattcgccagcagcgccgtcagccagtcatccaccttctgcagctcatccacgtttcaccgtccacatttcttcgggttcgtccggctccggcaccgcttcaacgctcgatacgctgccgtcagtgctgaccagcacacgctcagtcagttgcaggttcatgctgatatcgcacacatcgtttcgcagaatatccacttcaaaggtgaacagtttttcgcgcagatccgggttgttgatggcgtccggctgactggtactgagccacagcaggactggagccatcagcagattctggtcgccgctgaaatcctcgatcaccacgttcagggtgtagcggtattcccatgacatagaactggctcctgttgccaccagtgagccgttatcaacgaaaaggtgcagcttgtccgggttgtcccggacataggcaaccgctttattcagggcgctgcgtaaggactgcggtttgttcactgtctcgctcctgacacgcaataatcgtgtccactttgtcagcacagaccgcccaggcggcctcggtttcatccagcaccgcgttcagatcgccgttactgcgcggcgctgacctttccagacggcactgcgtcactctgggacagccactcacggtaagctgcacctccggcgagggccggacgctcccgcagccggataatgtcagcaggcaaaggagtatcagcccagcggcgcaaatcctcattttcacgtttcagttcctcgatccggtgctggcggctgcgcagaagtgcggtggtctgttccgctgccgcataaagccgcgcctgctcccggctgttggtttcggtcagaatggacaggccgatcagctggctgtttttcttcgtcagctcctgcgttttgcttttcagcaccgcgccctgcgtctcgatggtgtggctggcattgttaagccgccacgactgccagcccagcgccgcaagtaccagcgccagaaccactgccagtaaacgattcattcccgcagtgcctttagctcatcttttattgctaagctcatggctactgtaaaaacacacaccatccccgtgagcttccatccggcaagcaatatgacaaaggcaagagcgagacgctgataccagatgagaggtactttatccattagccccagcaccctgctgagcaactgacggacgcgtagccgatcccccccccgtcagggtgcaggagtacaaaccagcacaacaaaccagtgaaaaagcggcatactcaaaccacataaccagcgccagtgggaaaagcgcatgagatgccgggaaattcacatcaaccatcacaaggagcgccagaaccgagaacggcagccagtaactttttaaccatttcatttcgctatactccttttaagcaccaggtcatttcccgcgcgcggcggttgtccagcccctgattaaacacacctttgacatatacccagcgcggcagctgatggcaggcatccgcccagcgccgctggttcagcaacttaaccagcgtggagctgcaggcgttgccggtgcccacgttgaaagcaaacgacaccaccgcgtcatagaccttttgcggcatcggctgtaccacacatttatccagtgcccgctccacgcgcagcacgttggtgataagtccctgcgccgcctgccgttccgtgatggtttttccaggcaccacaccggacgtattgccgatcccgtcagtccagacgcccgcgctgcactgataaggctgcaggcggcatccctcgtaatcggcgatcagtttcagcccctcaacggaggtatgaagcgactgaaatccgggcagcgtggcggcgatagccagcaccgccacgacaaggcagcgcttaacgattgaaggattcatattccccccgcgaaatcttgccgccacgtaacaatttgaaagactggtgtttgtagtaccagttgatagccagcatcagcacaccaatcagtacgccgccaaccgttgacgcatccttgagcgacagatcgcccagccatgccagcagcacggcgatgcagtaagtgataaaggcgctgattcgttcaagcgtcataattcagtcccatagctggacggtctgcgccgtggttgacgccgtaatgtccggcagctccacctgcagcccgtgcggtaaaaatgggccgtactcagccagccccggatttgcatgcagaacctgctcagtgacaccctgcgtgcgcccgtaatgacgccagcaaagcgcgtccaccgtgtcatactgatgcgcacgcactttcatcagataagctccaccgtacagtgcggtacatcctgcacccggctgatggcccagcgggcatcacgccacagatcgccgctggcctccgccagctcctcccctcgcttcacgcctgacgccgtggcgtcatagtcctgataacgctcattaagcacagcgcgcgcccagcaaaaaacagcgttgtggtagtgccggatacgctcgcttttaccgtccagcatttctgcgggaacctcagcaagtgtccgccagcccagcatctgctgacggttgcggaagtcgtacagctcagcgttaacctcagagatcgccgtcagcacgacctgctttaaacgcggctgcgtcaccgtgccgtcagtgcgcatcacactgcgaaattccgacaggtccacatcaggccagaacggcgtatttttgatgacctccgcctgttccggtgcctgttcgggcgcaacaaacttcatgcggctttctcctgaataagtgggcggtggacggaattttgatgtggcagtgcctttcgccatcccgtgccgcccgtgcgcggggcacgttcgttagcggctgtcattgcgcagtctgcgctccagctgctgcttttcttttttcacaccgcagcggggatcgagctgcagcgcatgggtaaggtgattcagggcagacgccggattgctttcgctcagtacagcgccgatggctttatgcaggcgcgcccgcgactggtccggcatatccagatcagttgtcaggtccagcgtctgcagaagcagatcggcatcaaaaccggcagcggccagcagagcgctttgcgccgcgtctgccatttcttctgccagcacggtctgcacgttacggttgcccagcggcatcacccagccatggcgcagcgcatgacgcccgatttccagcgcaccggcataatcaccggcatcgatacgccacagcatcacgtacatcagcacgtcatcctgctgcgcacctccggcagccagcacgccctccgcccaggcggaatatttcggcagcagctccaccttgatttccgcctttttcaccgtggactggatgcctttaaggcgacggcgatcttctgccagttgcagcagcatcaggtcatagccagacgcatggcggcgaacactgccgccctcacgggcggcctgttcggcctgaatgcgcaggcggtgctgccgtgcgggactcaggctcatgcgttactctccatttcctgactctgcggctacaacaggtgcggcaggcggagtgaaatcactcatttcgatgttttccaccagtgccgcgcagcggtagtcctcgaccacatacgcctcgttaacggattcaaagttttcaatccggtcacgtttcgggttgtcgataacagaacggcggcgggtgtcttcctgccagtagatggacaggttatccagtcgggtgattaacaatgcatttgccgggaagaaaggcgcacgcacagcctgcaggccgcccatacgtttctggctgatgatcatatcggcggcaattttttcgctgttgtcctgctctttgttgaccagcgggaaatacttgtcagacagcagttcacgaccacagacaacaaccagctcatcatcatcctgatactccacatcgatcagctcgttgacggcatccatcaccacagcgtcaaggtttacatacttaccacccggacctacttttaccggctccgcagtagtggtgccgtcttctgcggttttactgcccataacatgatccggcgcgtcttcgcggattttctgtaaccagcctttattgacgtcctgcagcagcgggttttcagcacgatttgaggttttggcgcgcttcacgccgttaaagccgatcatgatgcggtccagcgcctgacgcttgacgatggcgttgcggatacgcacctggaagtcctggaacttggcccacaggtccagttttgcgtaggtcagcaccgtatcaaagttggtctgttcgcatttgtattccacgtcttccatcagcgtcggatcggtaggctcgcgctctttggtggtggtatcggtggttccggcaatggtgctgccaacgcccagccccagcaactgtcctgactgttcagtgaccggcgtgatgttaatcagcgtcaggaaagcggcggactgctggatctggtcttccagcgtctgctgcacggacggctccacggtaaacttgctggagagttcttcaacctccacactgttcaggcgcgccaactgctgcaggtaagcgttaaaggcaaagcgggttttctttttcatcgggttttatgctccatcagcaattggtcagggtgcctgccggtgcgtcaccgcccggcgcgcgctggcggtagtctttacggctgtcttcgctgctaagcttctgctctagctcggcaaaggcggccagctgttcctgcagggaggactccagctcagaaaggcgcttgtcctgttcggacagggatttatcagtgcgctcgctcaggttctgctgctcggaggcgaccagttccacggctttatgcacatcggagaaacgcgcctcatcggtctgctcttttttggtgaacagcgcggtgacgcgggcaaagagggacggcttttcgtcctggacctcttccagttcgatcagcgtttcgacagcttccgaaaacaggttttcagggttctgcttacggtttgccagcggattatgtgcggcgctggcgctgaaagccagcatttcggtgccaaggctcgcaggatcgtccgtcgcacccagccccacaaggtaggctttgccggtgtcggcaaacttcgtgctgacctccatggaggtgaaaagcttctggccttttttcaccagttccaccagggcgtcagtgggttcgatatcggcataaagtgccatcttgcccgccagcgggccgtcctggatttcttctgcaaccagccccgtcaccctgccatagcggttaaaagtgctctccggcagataagacttgatgtgctcaaggttaatcagcgcggtatagaccgtcgggttgtagctggcagccatctgtaccagccattcacgctggatctcgcgcccgtcagtggtggcaccttccaccccgatgcggaaacgctttgctttcactgtcatgagccgtgctccgttagaaataacttactggagccttatgtttgcggtgatagggggagtgagacaacgcgctgtatttgtacggtaaaccacacaaaccgcagccggggaaagccgccatccaaggccgtatgtttgggccatgaacacgacactgacccccgcagacctcgatccccgtaggcaggccatgctgctgtactttcagggataccgcgtagcccgcattgctgaaatgctgggcgaaaaagttgcaaccgttcacagctggaaaaaacgcgacaagtggggcgactatgggccgctggatcagatgcagctcaccaccgccgcacgctactgccagctcattatgaaggagcataaagaagggaaagatttcaaagaaattgacctgctggcgcgccagtcggagcgccacgcgcggatcggcaagtttaacaatggtggcaacgaagccgacttaaaccctaacgtcgccaaccgcaacaaaggcccacgccgtcagccggaaaagaatgttttcactgatgaacagatcgaaaagctggaagaagtcttccacgcctctatgttcgactatcagcgtcactggtttgaagccgggaaaacaaaccgcatccgcaacctgctcaagtcgcgccagattggtgccacgttttattttgcccgtgaagcattgattgacgccctgctgaccggacgcaaccagattttcctttctgccagtaaggcccaggcacacgtctttaagcagtacatcatcgactttgcaaaagaggttgatgtggagctgaaaggcgatccgatggtgctgcccaatggcgcagccttgtactttctcggcaccaacgcccgcacggcgcagagttaccacggcaacctgtaccttgatgagtatttctggataccgaaattccaggagctgcgcaaggttgcctccgggatggccattcacaagaaatggcgacaaacctacttttccacgccgtccagcctgacgcacagcgcgtatccgttctggtccggcgcgctgtttaaccggggccgagccaaagcggacaaggtggatattgacctgacccacagcaaccttgcgcgcggcctgctctgccctgacggacagtaccgccagatcgtcaccgtggaagatgcggtgcgcggcggctgtaacctgttcgacctcgaccagctgcgcatggagtacagcccggacgaataccagaacctgctgatgtgcgaatttattgacgatctggcgtcagtattcccgctcagcgagctgcaggcgtgcatggtggacagctgggaagtctggaccgattttcaggcactggcgctgcgcccgtttggctggcgagaagtctggatcggttacgacccggcgaaaggtacgcagaacggtgacagcgcaggctgcgtggttatggcaccaccaactgtaccgggcgggaagttccgcattctggagcgtcatcagtggcgcgggatggactttcgcgcccaggcggacgctatcaaaaagctaacgcagcagtacaacgtgacctatatcggcatcgactcgaccggcgtcgggcacggtgtttatgagaacgtaaaagcgttctttcctgccgtgcgggagtttgtctacaaccctaacgtcaaaaatgccctggtgctcaaggcgtacgacattatcagccaccgccgtctggagtttgacgccgggcacaccgacattgcgcagtcctttatggctatccgccgcgccaccaccgccagcggcaaccgtccaacctatgaagccagccgcagcgaagaggccagccacgcagatttggcctgggcaacgatgcacgcactgtttaacgaaccgctgcagggcgaatccgccaataccagcaacattgtggagattttttgatgagtgaactcgaagccttaaccagctcaacgccaacagaagctacggtgcctaaaaacgcaggcgtaactgccgaggctttcagctttggtgacccgatcccggtgctggaccgccgcgagctgctggactatgtggaatgcgtacagatggacagatggtatgagccgccagtaagctttgacgggctggcgcgaacctatcgcgccgccgtgcatcacagctcaccgatagcagtgaaacgcaacattctgaccagcacctttatcccgcatccactcctgagccagcaggcgttcagccggtttgtgcaggactatctggtatttggtaacgcctatctggagaaacggaccaaccggctcggcggcattctgtcgctggagccatcactggcgaaatacacccgccgtgggatcgatttagacacctactggtttgtgcaatacggcatgacaacgcagccctacgagttcaccaaaggcagcatctttcacctgatggagccggatttaaaccaggagatttacggcctgccggaatacctgtctgccatcccttccgccctactgaacgagtccgctacgctgttccgtcggaagtattacatcaacggcagccacgcgggttttatcatgtacatgaccgacgccgcacagaaccaggaggacgtgaacaacatccgccaggcgatgaaaagcgctaagggccctggcaattttcgaaatctctttatgtactcgcccaacggcaaaaaggacgggattcagatcatcccgctgtcagaggtggcggcaaaggatgaatttctgaatatcaagaacgtaagccgtgatgacatgatggcggcgcaccgcgtaccgccgcagatgatgggcatcatccccaataataccggcggctttggcgatgtagaaaaggccagccgcgtatttgtgcgcaatgaattgatacctttgcaggagcgaatgaaagaaattaatgaatggatagggcatgaggtcattaaattcaaagcatacattcttgaagtaatataaatatagaaagagtgcctttaacaaaggcactcacctcataatatatccagcgctaaagataactagaaaccaatatcttatgaaactaaatcttggcaagcatctcgtctaaaatcgcttgccttttcattctatcatccgtaatgtcatcgatcgacaaaacaatatcgacagctctttgaaaggttgcctttattttatctccatgttttgtcatctcagttataattttattacaataaatatccattttctttgagccaaactttggaatgtcctttccagcaattaacacgcaaacaacagccattagatgccatttatacttcctaatgttttgtgggatatctgcattcgatgtaagcaagtgaagtctatataacgttagacatgccgcataaaatacaatttctttcgtgtcattagaaaatattttctcagccagtaattcgtacattcgctttgggtatctgtatgaaagatctggccgacggaaaaacatagctgcgacacatttagccgccatatgaactgaaaacacccttactgcaggtatatctctaccgataaattgtctttcacgtctttctaaatataagcggccgtcttgtccttcatatgtgtcaaagtacgcttcgacttttttaattattggacgaagagaatagaattgtgtttcgtcaactttagtttggctgttagtggcacgaactagttctgaaaaaacatcttcattcaatgtttcaacaaccttcaaattaaccatcatagtatcatctaatgaatcacggcactcataaagtacgttagatgtttgacaaccgttgactatttgaaaattttccaaatgcaatatactgccttgaagctttacatctgggcttactatggtaatcccattattaagaacaggaaatcttgaggccgcatctctatctttaattgtctcagcaatcgacgcattaacagggttgtctattcccaagaaagctcggacgttctcaacaaaaacatgattacgaagagaaccctcctccgtcattaaaagattactaacaaaatcctttgcttttacaaccgcaagataagcctcttcgatcccattaatttttggtagaggagcattactaaacaatggcaattcagcattaaccacagagtatgtatcaatccaagtcctagttaattcatcacgatctacaaactcaacactaacattacaaaaataacctaattcttcgatttcttttataaaaagttttcgcgcggactctaactctctagggctcttatatattcctgtggcaacatatttagcggtaaaacttgggcggccgcctcttatcttaggaacattttttatcaccacgtcaaatacttcatgtgcatttttttggatatcatctaaacaagagtatggagactcatcaatgaatctaaaaacagatgctttaaattttaaaaaatcgcctaaatcaaatgattcgctacgctttgattgtataaaaacgatatcgacatcgtgatttttacgttgagaggaaaaaatagaagacgcatcttccggagagatgcataactcttcgtcaattatgatagcaataccatccatgccatcatcaccagctccggtcgttacatcatctatttcaaaatccatactgattcgagaagatagcatggctttgttacagaacaactcgaactgcacatcctcttcatgattttcaataccgtaactctttacgaagctatcaagatgagccttaacaattctatgcatgagacatccctttgcgaaatgacgaatttttcttatcgtaccacttgatttcatcttttgacatgcttgcgcgcgctcgtatccccgccacgcctgcccgctttatgtagtggttttcatgcacctgcatgatctacgcaaaagcccgccagaactggcgggccttaacacaaaagatcctcaaacgatcatgcgatctcatgcagcatagacatgcgcgtttatgcagaatgtgcaaaatcgtaacatagtccgtaagcgtgaaacctagaacgtgacagccttgtcaaagccagaaataattgtataagaaatagacgagttatcagccttgttcactttgaacttggcacctttgtaagcgataacatcacttcccttagaatctacagaaaaatctgttgtaaatgctgcacgagccatatcgtttgcaaattcacgataggtgaacttcattacaccgcctgcatttccattgtattcgatagtcttaaccaatgagttactcactcgacacagtccatcaggaacacgtttgatagaaatttctgatgcagaataagaagtgccatttggcggtgatatctcattttttgcagcatcgtaactaacataatcaacatagttaccgatttgcccatagagattttttaacgcaacagcttgagggttatgataattgcggtaaattccattcccctcactgcaatatgtaccagcagcgatagaagacaatgcaccattagccgcaccaagttctagtacgtccgttttaaatccagtagcagatgtgataatgggatcgcccatgtaggcggtagcactttgcccaatagcaggcttcaccacttcaatagcagtgatatttcggttagaagcatgtggcacgcaaccagttaggattacagcaagagatattgttaacgctacattattaattttcatttttagcctattattcttttcttgacgaaaaacaaggcgatatctgattgacatcgcctctcactcatatgtaaccctttttgattagtaaaaacaagcgtctattgacaaaatcaatgtagccagctgtcgtcttcccacaccttctgcataattttcatcacttgttttctttcttcatccagttgcaatccggtcagttccacaccgttagagctacctttgcggatacgaattaccgttttgggatacagggggcgcagattgcggtaaagctcggattcaagggcgtccagggtagactggctaatcttctgctctttatcgatcattatttcaatgcgcataaaagtcacctcaattgatgacatccattgagcggttgtattcgtgggttctgatttttgccatgagttcatctgtcagttcagaaacccactgcagggccagccccttctcttcatcactacactcactagccgctacaagcttaagaaaaaaatcaatgcgctggagcttcaaagactccaaaaaatagtcctgcatctttcctcctatgacaccacaagcaatactgtacatataaccactgtttatatttacagtatataataatcttactgatgtaaaacgttttttacgttcatcagcctgatatgcctggtattattaagagcacgaattgttaacccgcgtaattaatactggttccgccacttatcatcttccttcagacgctggttccgatagaagatacgcaggcctgctcctgatggaatactgccaccgcgaaggagcaaatcgacttctttctcgctgccatcaaatcctctggacttcagttcatagacgagctgctgatgctgatgatctgtaattcgctgtttgtagtctttacgccttttcggtttaaccaggcgcaaccttgctgccagctcccggcgatcttttttgctcatactgtacaggtaatcgtgcaattccttgtcatccatgcgggtaatgtccgttctggtgcccccatcagctgatttatctttctcctgttggttcaaattttcagcaaggggacagttattgccacgagtccaaggggcgcaagcgccctggtcggctgccgcctcctgaacgtcaacggccttacgaacctttttccacttcatcgcgtgcgtgcaaatcttgccctctgcaatcggggaccagatgccatagatacggataccgtgatcgccgtaggcgctcggttcgtcgttaagctcataagctgtgcggacaaggtgatgtttgcggggaaccagtacaccgccctgtttcatgatgtaggtggcaaagcaacctgcatccgcagctgccagtaccgcatccagacgcggattatccagtaccggcgcacccgctttgcgttcgccttgtactctcgccgcctgacctgccagcaagcgcagctcgcggtatgcctgacgccccggaataccaaagaaacgaaattgctggacacggtgcagcgacgcccaggcgctgacatgctcggcgctatcacgcagtggtctgccggtttctttgctgatttctttagccagcccgcgcccgtcgatgttcttactgatgtatttggcgatgtagcttgtcggcgtgcccttgcgcgggttgattagctcggacttgaagcgcggcccggtattggtgcccagctcctcgcggtcttcacggatggcaaacttacgcagcagcgcggtgatggaacgacggtcttttttgcgcataaagcacagaagatgccagtgcacggtgccgtcatggtgcggctctgcaacgcggacgccgtaccagcgcagcccggtcttgtgcatggccttgcggaaagcggcgaatgtatcaaccagatagtcactgctctgccggaccgtggcactggtccacttcggattaggcctgccgttgttgagagttgcgtggaagcgtgacgggcaggtgatggtataaaacaccgcgcagtctccgcgcatttccgcgatcagctccagccccttaacacaggccatcatttcattacggcggtgcgccgggttgctgttgctggcgttcaccacgtcttccatgtccagcgtgtcgccgtcttcgttgatcagctcatgcgagcggaagaactccagcgatttgcggcgctgctcgcgtttgtggatcacggcttcgtagctgacatacggtgaggctttcttgttgaccaggcagacggcgcgcaactgctcctcccgccactcgcagcgcatctgccacaatttgcgacaccaccagtccgcgcacagcatacgggccagcgacggtgggatcagttcataaggcaccggcttacggcggcgctttttgcggcgcaactgctcaaaggctggcggaatgacctcaaggcgcatggcttctgcagcaaccctttcccatgcctggcggatttcttctggtttaacatcgtcactgacaaacagatcaccgcaggccgcatcaagacacatgctcatatgtgccgcaaccagcgtggataggcgtttgacctgatcctgattcatttcagggagtaccagcagcccctccagcccgtcgtggctcgccatgaaccggaaagacgcagacacctggctgtcacgcacgcgctccagccgctcaagacacggcctgattgtttcgcgcaggtagcgggaataagcttttgctctgcccaggctatggaaatatttaatccgttcaagtagcggcttgctgatatgcgccggttgggcgcccacgtcggcaataatgaccagatcgggattaaaacgttgctgctcacgcgccgttttggcatggctaatcagccgatcctgctctatttcacgctggacaggatcacgggattcattgaagaaatagcgttcccagacctcatcgctcagcgtctcacggcgcaactgctcctgctcgttatccgcagcgtaaagagcgatcaggtttgaaagcgcagactccggcgcaacttccgctgggtccagatacgggttaaccgctttttttggggtattccatggaaagaccacggcggcctcattcgaaccgccggtggttggtgcattatgtaatgtgaatttactcactgccacgcccgcacctcagtttctaccgagatatcaggaccagacgccaaatcaacaccaaaccagcatgctgattttgtggcgatgatttctactgcagttttactatcaccggcagccacgcccatgctgcgcttagcggttatacgatggcgagtaaaatcacgataaagcgaacgggtcagagacgtatcgctgttggacacgataaccggatgaccttctgatgaccggcgttcaagaatagacgccagatggaactgatcattctctgtaaaaccagctgtgtgatatccgttaaacgtgccgtcatatggtggatcgcaatagacaacatcacccgtttgcagcagtgccagtgtctcgtcatagctggcgcagataaacgttgcgcgttttgctttttctgcaaatgcacgtatttcgttttcagggaagtacggctttttataattaccgtaaggaacattaaaataaccgtccaagttatagcgacacagtccgcgataaccatggcgatttaaatataagaaatacaatgcccgttcaattgcgccaccatggcgcaagttaaactcctgtctcgtcttataatatgcctctggatcattacgggcttcaaaaagatatctgccctctttgatgaagtattcaacatcattcttaatcacctgatagagattaatcaggtctggattaatatccgcgacaagataatgaggatagtctgtctctatcatcacagcgcatgaacccgcgaaaggttcaaccagtcgcgggccttctgggaggtgttttttcagttctgccatgatggcggttttattacccgcccatttcaggatggtgctcatacagcacctccgttgtagtgtttgcctttcagctctgcgatttcctgacaggtgatgcagcactgcacgcccggaatggcgcggcggcgtgctggcgggatcggtgcatcgcaatcaatgcagagaacacgggaaacgcccggcgttttattgcgggcggtatggatgtggcgctggcgttcttcttcaacgcgctgctgtacgaggtccattgaatcagccatcagtggatctcctgcgcttcgttctgaatcttcaccgcttcttgacgcagcagctcagccgcttccgtgtggttaagctgacgtgacacgatatgggcagccaaagagtccagacgtgctgccatcaaatcagcgcgtccacggcgttcttccatgcgcgcatcagtcagcagctgattaaggccagcatcatctggtccggttttagtgatacgggtttcaatatttcgcattgttgtttctcctgaatttgggcaataagaagcccggcgggtttacgccattaatttctgttgtgggttaattcggcatagttagccgttttggaaataagctcaccactgcacgaaaatgattcattgctttaatcagttcccgcttttcgtcagtagtcagatcactaatattgacgctatgacgttctgctggaatctttgccatatagaatatggctgccagtgccctctcattttgtttattgttaacatccctttggtcgcgcatatcttcaatgaacctttcaagctccgactcaatattcaggccgaacacttttgcgcgtaattcagcaatatgattcaacccatccaggcgtttgccggggcttagtggaactgtcgccaccgggccatcaatagccattctccctcctatctcgtcgtacatatacctatttgaagttgtgccgggaattttttcacacgcccggcgcgtgccttagtggtagactatttgcgccaacaatcacctacccctcgaaggagaaacctgatgtcagactctgacaacttccatgtattgcctcgtcctgcccctgcacctaagccagaaccggggcaagataaaaaataggaatccggcatgactaaacaaagctccgaatatttccagttgcattactgctattaccttgagcttatgacagcgacacttcacggtagggctgacaaattgatgactgctattcagattattagcggtactgctgtcatagccgataccgggctggaatgggtattcgctttgcccgttgttgtaatcgcaacaattcaacttgtgtggcaacccgcaattatttccgagcgtgctagcgtacaaagccgtcagtacggtgaattgctttatgctggggatgaattgaccccggaactgattgcacaaaaattgaaaacactgcatcactctgattccgcacctttcggttctttgttaaatccagcctacaaaagagcagctattgcatgtggtcggtctgacgacactaagctcagcttccaggaaaagcttttcgcctggtttgcaggatgcctgccacgttaaaacttagacgttgtagcaatctctttttacctattccccggacagcctgctgccggggagacagttcaatacatggatgccacttttttccgcaaggtaaataaatccagccgtgaccgtagtgcattgctgggctttgcttaacgagaagtgatgcaaaagatggttctctagtcagcatagccacctcagatcagaccgaatgaagcgccgaggcccgtcacggtatccaccgcgcttgccatcgccgggttagcctgcaaacgtgcctgtatggaaacggcagccagtgccattaagcgagtaacagagttgatgctactgataacatcgcggcggcctgcagtagttttcacatcacccgatacagcaccggcagcaatacgtccgatttcagcagtagcgctcatgacataatgtggcagcttctcttttgccacttcgttcatcggtacgcatggcaggcagtgaatctgagccaaaaaaccgtcaacgagcgtagagtcctcagtaagatcggtaagcagccagatctccgacggcgtgagctgatgcggttgttccgggttcagcttgttacgcagcgtctggactttcattcccgcgcgttctgccagcttcgccatgttgtgacgcagcgcgaaaacccggcaggcttcgtcaaagtgtggatgtttggaaatcttataatcaaacatgcaagccccttagaaagttctcataatcgaacttactaaccaacaatgacgcggaagttggaatgaccaagagactcacgaacctggtcggttttgtacatcaggtaccgcaggcttacacgtcctttatttttttctttcttcaccatgtacttagcaagctgaccatggtgaattttttgatacacagagccacgggagataccttcccactccgcgaactcagcaggcgttgccatctcttttggtacacgaattgaaatatcagtactcatagtgcagtatctcttagtttgggttcgttttatcttgttttatgtggtttggttttgcttttcaaaccatgaatggatattaagatcactttttatatacgtcaagaggtttgattatgagtttaatcaaggcggggaatgatagtggtgggcgcgatgcgattaacaggcttattaaggcttacaatttcagctcacgacagcagctctgcgaacatctggaagtatcaaaaagcactatggctaacagatacttaagggatagtttccctgctgaatgggtaattcaatgcgctcttgaaacaggaatttcccttctatggctggctacgggacaaggagatatgtatgcgtgtgagaacgaagaaagaaatctcaaaaacgaaacctccgtcacggtaagaccactttctaaaattgttgctcctagcatcaaacatgttgaactgaagaacggtgaactgcagccaagtgatgaaattcttcttgatagcagactgctcgatggtgactcatccaactctttatttgtaaaaacagctactgatagctttgttgtggatacgtctgttaaacaagtcagtaatggcttctggttagtcgatatggacggagttaaaagcatcgtcaaaatcgctcgcgttccaggcaacaaaattgtagttcaccaagatgaaacatcatttgaatgctcggtcgacgacattgaagctatcgggcgtgcagtcaaagtaatcaagagcctctaacttatgagcatcagaaaacagcctaacggaaaatggttgtgtgaatgctacccgaacggacgggatggcaaacgtgtacgcaagcaatttgcgactaaaggcgaggccatagcattcgaaaaccacaccatggatgaggtgaacaaaaaaccgtggctgggggagaaggaagatcggcggcatttgtcagaagtgattgatcagtggcattcactttatgggcagacgctggcagaccccaaacgcctgatggcaaaactcagcattatttgtaatggcttgggcgatcccattgcctcagagttaaccgcaggcgattttacgaaatacagggaggcacggttaaaaggcgaagtaaaaaatgaagatggcgtgcttatgtcgccagttaagccccgtacggtaaaccttgaacaacgtaacctatcatctgtttttggcacactgaaaaagctgggccactggtcagcacccaacccgctcgctgggctgccaacattcaaaatcgcagagggcgaactggcgttcctggcaccggaagaaattaaacgtctactggatgcctgtgctgattctcagagtcccagtttgctgatgattgcaaaagtatgcctggcaactggcgcccgatggagtgaagctgaaaacctgcagggccatcagctatcaaaataccgcatcacttataccaagacgaagggcaagaaaaaccgtaccgtgccaatatctcaggatctgtatgacgaactccccaaaaacagagggaagctattcacgccatgcagaaaagcttttgagcgtgcagtaaaaagagctggtattgagctaccagaaggccaatgcacccacgtgctgcgccataccttcgccagccactttatgatgaacggcggaaacatactggtactgcgcgatattctgggccacgcagatataaaaatgacgatggtttacgctcactttgcccctgaccacctcgaagacgcagtgacgaaaaacccgcttcacaacctcaattggaaacgctaatttatggcggcattttggcggcagggcactaaaaacgcgtaaaacggacgaacactgaataatattaacccgctgtttttaaacgcaatacactgtttttactatactaaaaatggtatgtaggaatttcggacgcgggttcaactcccgccagctccaccaaacattcattcatgatgcatcatgaaccttaaaaaagcctgtaacttcaatgagttgcaggcttttttgttgcatgtgtggtcatgatctctgtatgaatcttgagcttttggcaccatgtttagcaccacggtatcgtggggctaaaaaagcgtggtgctaaaacatgcctaaccaactgaaacccttaacaaatgtggagatcgctggcgcgaagccccgtagcacagactatgagctacgggacggtgaaggcctgtacttgctggttaagacttcagggaggaaggcctggcatttcgagtattatcatcccgtcaccaaaaagcgcaccaaaaccagccttggcccttacccggtcgttacactggccatggctcgcgaaactcgcacgaaatacagacgactgctctatcagggcatcgatccccgtcaacacttagcaggaatagctgaagaaaaacgcatccagaatgaatgcacgctggaaaaagttgcggaacagtggctcaaagagaagaaacggaccagcgatcttagcgaagatcacgccaaagatgtctggcgctcgctggagatgcacgtcttcccctctctgggtaacacacccgttaccgagatccgcccgaagatgctcaaggaacacctcaccccgctggaagaacagggcatcctcgaaacgctgcggcgagtcatctcacggcttaatgaaatcttccgttttgccatctccgaagagctcatcgaattcaatccggctgacaacctggtcgcccgcttcaagaaaccaaaaaagcagaacatgcccgcccttcaccccagtgaactgggcaggctaatgctggcgctacagaacgcttctatccgcaaggaaacccgctgccttatcgaatgggagctactgacctgggttcgccccggcgaggccgtcagcgcccgctggtgcgacatcgacatgaaaaaagcagaatggcgcatccccgatacctttatgaagatgaaccgttcgcacacggtgccgcttagcaaacaggcgctgcgcgttcttcagatcatggagcccgtcagccgccatcgtccgtgggtcttccccagcatccgcaaaccactggagcatatgcaccagcagaccgcgaacgccgcgcttatccgcatggggttcggcggcgaactggtcgcccacggcatgcgcagccgccaggaccgcaggcgcaggtcattttccccgtgaagtcctggaatctgtgctggcacaccagaaagaagacgagatcgaagcggcctacaaccgcagcgactatctggaacaaaggcgaccgctgatgcagtggtggggaaactacgttgatgccgccagacggcaggcgctgctcggtgcagaagaaccgctgcaaatcgtggaaggagaataatgtgaccagtcccattcgtcagaatctgtttgaacgggaatgtgatatgccgcttctggaagcgcggcatctcgcccttctgcttctaggcctcgatgcttcccaacctgcaaacgccctgccggaagaacatcaggaaaactaccgtatcctgcacgacgccatcagccggaccattaaggcaacaggcatggtcagtgccccggcgaacaagcgcatgttctatgccgatgagatgtttgccctggcctggcggcttattgatgacgaactgacgccgtcagaagtaaaagaccgtagcctgaaggcggtgatgaaactgtcgcgtaatagccgtggccgcaagtggctgaagacgctcggcgacgacgcactaccggatctcacggcttcaacacaaccttccctgcgtggaatgcataagcgcgacaaagcacgggagaatactgcccgactctgctggctgctggttcagcttctggttgaggagactgatgggcgttatgggacgtcggataaaccggcttctgaccagatacttcgaaagctgaagacgctggctaaggaacaggaattgccgtcggatgggcttggacgggggacattttatgaggtgttgaagatggaaagagaaaagtgagtataggtaattgatatctgtgtaagatgcagcgaaccgaataaaatctgaaagctcagacgtatagtctgcttcgtcctgtgagttcaataggttgatgcaacgctatccttaatcaagggggacgttgcttgtgtaacatttaatctacggatattggtcattaatgcgggttgatgttgtactgtcatgattgagcgacctcaggttgagggtggggctcacttatatacgtgtatccattattagtaggtaaattcatgtatattggctacctaatttagccactcctccgcacatagttaactcctgatttgagatagagagggattatgatgctaggaagatttattgcttagcatatagcaggtgatcttttacctactggagtggtaaattacccctatttttcagtgaatgttttgtcagggagtattaatttcgtggaaaacgataaggtgaagttaggaagaaatgataaatgctggtgcaaatcaggacttaagtataaaaaatgccatctcgatcgagaccgtgaaatgccggtatctaaagccgaagccctgaaattttcaaagtctaattcgcagagaaaggcgtgttatgcaccagcatccatgcacgaagattgtgacaaacgtatcgttcaggcgcacacgctttctaagagcagtagccttaaggcgatcgccgactctagtaatcatgttatgggagtggtaatgaacctgccgagcctgataaaaaacaacggaagatgggttccagagaagattggtatcaatcaggcatccacttttaccggattttgtgcagttcatgacagaatattattttcatgtctagagaacgaaaaatttacaggcacggatgagcagtgttttgccctaatgtttcgttcgttatctaaagaaatttacgccaaggaggggggaagacggtcttccgattttgctaaaaatgccgataaaggaaagttacaggccgaacaagtctatattcaggaatttgtcagcctgcatcaaagcggtttgaatgcagcaataactgaactaaataatcttaaaactagcctcgaccgcattctgcttaacagacagttttcagaaattgaaagtgttgtcttcacgttttcagaaccattacccattgcggtttcgtcaattctttcaccggagagggattttgatgggaccaaaattcaggatttgaacgatcttaccgtgtcggcggaacaggtctgcttcaatgctttttccagcgaaggtaagggatatgtagtgttcagttggctgggaacttcagcaattatcagacgttttgtgcgatcactaattaaggttcaaactgacaggattttcaacaccctcctgtattttttcttcacaaaagctgaaaatacatactcatctcctgagtggtgggacagcctcagtgacaaacagcgagagaatatcggcaatatgattatgtcgggtgttgacttttttgataattctacattacgcgtcgatcattcagttgattataactctgctgcgcttgcagagataagatacagcaacagcgagatttccagttgaatgctttaatgccattagaaaaaacgggccaatcagttgtaccgaaattgtaacgataagatgtcaccgccttttgctgccagatcggcatctttcgacaaactgatgtaggctgctgatttccgcttaagcggaggttatcaggttagggatgctatctgcagataggctatagtaactgggtactctccccaattgtaattgacctgctctccgttaatgaacaggtcacaatcgttgtaatgcggccattaggagtttccatcgtagtattttatccagtcacaatcggagtaaaaaataaacatatattctatcaattcactcattaaatttaatctagcctacatacaccagctggttttattttttcagtaatgaaaattaacatatcgatttcattcttcttagggactaacatcgaaaccccatgtacaagactatttctaacctcagtaatttttttaataaaagttgcatcttgcctagaaattattttgttttttactaaagcattgactactttccctataaaaagagggcgattaggttgtttagccgaaaaaaccttatgccttgcaattttttcaaaattaatccaagcagagatgaaacaagtaaagccagatacaaacatatattcttcatgatcaatgtctggcaggtgcccaacaactgaacgaatcatgtcatctggtaagttgaaaagttcacgttcaagatctttcgctacaataactccagtatcaattaagttaaaatcactttgcaaaacaattaattccttgtgcaactgcggtaaggaacccttatatttatcatttaagacaaagtaatattttttaataggacatatatcatgccagtaatcccttaacccttcaaaatcatcttttattttattaacagcagctagtacattattagatgcatcttctggtgcatacacctgataatataccccctgccccttaataaaaccatcattctttctgtctccaatatttccataaggcttcacctgctgaaaatctggcgacttatagtacattatttttgaaaacaagtcctcaaagcgaactccgtcagactcatagacttggagatgaaacatgtttctagcaatagataatgagatatcatccatagtcaaaccttgcataattagagtaaattcaacaacatttacttatctaagttatatgaaacttggcgttaccacaataacagaaaatattaaattgttagttcttctgactgcccctgttgattaacacaccgcaacttaagtaatgccatcatcagtggttagaacagttaacagcttcctcgcttacaactgacgatgagatagcggcagctattgtgaagtgtttgtagtcgtgcgttgccattcgttaaccatagcaaatattatctcgacggagctcaactggataaaaaccatttattttcaataaattaatctaacaccatcagttttgatggcaaagaaaatcttcccggactctttactttctatccggacttaactttttcacccggacctatacctcccctccccgttccgcgctataaccgcctcgacactctgttcccgtgaggtgcaatcatgaaaatccgtgctgacagtaacgatgcttttcccgaaagcggcaacgtgcgtatgcggcaggtggtccagtttctggcgatgagtgaatcatcggtttaccgcctgattaaagacaccgactttccccgccccgtccacctctcttcccgactggtggtcttcgatgctgcggaaatccgtcagtggcaacagcgccgcaccgtcatccgttaatccacgctcagggatgagccgactgataccccatcatgaaacgcgcgccctttctctgtaagcagtctccggaccgcacgctcgaagtggtgatccttgccggaagcctggcatgggaaacctcacgcgtgtggcgaaaagatcccgaccgggaagatgatgttcctccgatggtactcggcccgaatgaactggccgatctgagcaatctgaccattatcaggcccgacacgctctacgtccgggtacttcgcaccggcgatatcagtgaagaagatctgctgaaaattgccgtaaaactggcgcacgcgggtgtgcagatggcccggctgatgagccctgacggtgagttactggagaactggaccgggcagcttgaacgcctgcgacaggaaaggccttccgatatcctgccggatcacttccgcctcgatgaagaggcgctgtggtttgacaagctcaccgaacggcgcgacggcgaaagcgacgtccagccccagcgcatctgttcccctctgcgcgtcaccgccatcacctgcgacagccatgacggcagctatggccgactgctggaatggcacaccaccaccgggcagttgcggcgctgggccatgccgatggcgatgctcagcggcaacggcgaggagctgcggcgcatcctgctggagaacggtctgaccaatatctccacccgccccgccctgcgcagcctgctgtgcgaatacatctcacggtcactccccggacgccgggtcacctgcgtggagaaaaccggctggcacaacggggtatacgtgctcccggatgaagttatcggtcccgatggcgacaatgtcatccttcagggcagccactacctgactggtggctttgcgcaggcagggacgctggcagagtggcaggagcaggtcgccgcactctgtgcaggcaactcgcgtctggtctttgccgtctgctgtgcgctggccgccccgctgttgcgcctgaccggaacgggtggcgggggtttccacctgcgcggtgagtccaccgatggcaagaccacggtgatgaaagtggccgcttccgtctgcggtggcacggattactggcactcctggcgggccaccgggaatgcgctggagggaattgccagtcgccacaatgatgccctgctgccgctcgatgaactgcgcgaagtggatccgcgtgaagccgggatgattgcctatatgctggcaaacggccagggcaaggggcgcgcccgcaccgacggcgaggtacgcaaccgcaggcactggacgctgctgctgttctccaccggggagctgtcgctggcggaacacaccgaacgcgccggggagcgtatctacgccgggatggacgtgcgcatggtacaaatccccagcgacaccgggcagcatggcgcgtttgagcaactacacggctttgccagcggccagcagttcgccgataccctctgcgacagggtggcccgctttcacggcaccgcctttcgtgcctggctggccttcctcacccacgaccaagacgccagcaccacgctagcgagagagttacttcgccgctaccagaacgccctgatgccggacaacgctggaaaccaggtgcagcgcatcgtggcccgttttgccctgctggcggcggccggagagatagcgacgctgcacggcatcacgggctggcagaaaggcacggcgtatgaggcggtgcagatctgcctgcacgcctggctgaacgagcgcggccatattgccaaccaggaagatgaaggcgtgctggcgcagatcaaacggtttatcaccgcgcaccagtacagccgctttgcctcgtgggatggcccggaccgcccgctgaatatggcaggctttcgccgggtggaaaaagatccgctgacgggcgaggaacacacactgttcttcatcctgccggagggctggcgggaaatatgccggggattcagtcccgccagggcggccagattatgccaggaagcagaatgcctgcagcccggcagcgacgggaaataccagtcgcaggttcgcctgccggagatcggcaaaaccagggtttaccggcttacctcccgcatcctcagtatctgagtgcagtctaacgtgtcttaaaaaaaggtggtacagggtgggacaagtggtacacgcagagctggcgagggttacagcgtcccaccttagagaatttgattaaaaaaaagtggtacagggtgggacagccgttgctaaatctgtcccacttttccgactggcatttttcaggtggtacagcgcaaagccacggctggcgcggttgtaccacttgtcccacctgtaccacctcaaaaacagaatgaatgaaaatggcgaaaagggagtgaaaaggcaaaggctgaaaggaagggagaagaaggggaacggacttgcccgaaaaattccgaaacataaacaacatacgaagttgaagcaataacaacaacgtacatttcaagcgcttagaagcgagatttcacgttacagtaacaatttaatatattgatatcattaactattccccttatcttatattcataatataatcattgctaacattaataaaaagtcgagaactgcaatggaactcagaagaatatctgtaaataatttgttcggaattttaaactatgatattgatttagggaactcagaaacaattattattaccggaccaaatggttacggaaaaaccatgcttttaaagataattgacaacattttaaataaaaatatagattttttctttgatttgcgatttgaagaaataaaatttgaacttgacaccatattactatgtatagagaaacaaaaaaataagaatgttgcagttacggtagtcgattatgtaaacgataaaaaacgacaggaagtattcactctaaataaaaacaaagaacttgacgtcgattattttgatgaaatatataataaactattaatctgtgacaacatagattctgatcctatactaaaatcttacaatcatgaggaaatattaaattactataaaattaaaaaaataaaacttcataaagaaaagcatcataaaagtgatttcttggataaatccattcctaatgcagagttaacttttatcaaagcgcaaaggatagagaatataaaaaatgaaaaatcagcaatcgagtcacaagcaaatttccttcttgagttgataaaaagagctgctgaggaatcagcacaaataagccaaagacttgactccacatttccagcaagattatttgatagcattaacgaaaatatatcttcaacttctatcaatgacagattgataggcattcagagaaaaagagaactttttatgaagttcgggataataaagtctgaagatacttttatccctagaaaattcagcaatgcaacattaggaaaagagtactcaaccgttttaaatctgtatatttcagatgctttagaaaaactatcaccttatgaagaattatttgaaaaaataaatttatttgttaatttattgaacgaaaaaatgcttgcatttaaagaaatcaagatcagtaacgagcatggattttattttcaaagtgataatggagaaagaatatcattaagtaacttatcttcaggtgagcaaaaccaaatagtcatctattttgatcttatattcaaagctaaacaaaattcagtaattcttattgatgaaccagaaatctctttacatgttgcttggcaaaaagaatttcttgattcaatagcaagaatacaaaaacttaatgagttctctaaaataattattgctacacactcgcctcaaatagttaataataattgggatataacttacgatttattcgagaataacaataaaaacatggagggacaatgaacagcctccgtgatatcaccggtgtttcagactggatatctggaatgcttttgctttttagatcaccaaaatatagcaggaagatttttttcactctagaaggagaaagtgatattagatttcttaatactcattttgcagatgagagaatccattatgattcgccgtgtagtggtaaaccagaagtaataaatgctgtgcaattattgcgctctcatggaaaacaaaacgtatatggtttatgcgatgctgactttgatattttagaaggtaacagctacgaaaacattcattttacggactgtcacgatctcgaaatgatgttaatagaaggtggttcatttgacaaatttatttctgagttcttaaagacaagtatacttagaatacatactcttgaagatatacgaaataatcttaaagaatctataattgacgtgacttacaaaataggaatactaaaatggcttaatttcaaaaataatttattgttaatgtttaaaggaatgaaatacgataacttcataacctttgtggactttagtgcgaatatagacatagataattacattcagcacatcctcgacagaagtcctcgaaaacctccacactgtgatttcaattttttgaaaaaagagtaccaattactttataacaaacaagcagattataaatatgtttgcaatggacatgactttacgtatatcaccatgatggcctttcactcagaattttcccgtgataagaatataactcaagaaaaagttgaatcacatttaagaatagcatactcagcaactgcatttcaaagaacaaatatttataacgaactttcgggcttaatagatagccataatatttaataaattacattcaaaaaaaaatagcgaaatacaccgtttcaataccgaaatggtgtatttttcagaaaaaaaaccaccttcattaaaattaaatataacccattgttttattaaataaaaacacgagtggatgaacaatcaatgcaaataacctcatatattaccagacaatatcaatgtacttccggggttatttttcttaaaacggtgatactggaggatcaattctgcaagctcatcgtcaacagcataaaaatacgcttccggtacatcaagcgctgctgccagcttacagacgagtttgaaatcgggtgcatggacttccttttcatacgaactgatacgcgcgcttgcggattcttcatccagcccagcgagtgcacccagttccgcttgcgtcagatcagccctgactcttgaaatctttaatcttttaccaatcacgattgcaatcctgcacctgaacatgcaggaattatccctctctgggcagcaaccatcttcaggcattcccttacctattcatgtattacttgaattttgattacatttagagcaatattcaagaattgcgtgatttatcacggttaaaaagagaaaaccgatgaaaaagtcaacaaccaaagactggcaccccgccgacatcgttgccgccttacacaagcgcggtaccagtctggcgaagctgtcgcgggaagcgggactggcctcgtcaacattgtcgaataccctgacgcgcccgtggccgaaaggcgagtggctgattgccatcgcgctcgacatgcatccatcagaaatctggcccggccgttacctcaattccagtaacaaacgtgaaccccgaaaaccgcttcacccgatgacaacaaccgacaactccgggacataacgacccgcgctgtgagtggcaggacgcattaaccaacgacacctgacaggagagttgtttatgcacaccgaaccacaaccatgcaccatcgcaccactcgcaggaggccgccatgtttctggtctccctggctgaaggctttatccacctgttccaggccgcaggcaaaatctttctcgacatgatgaccgggcttatcccgatgctcatctgcctgctgctggccatcaatttcctgatgaagctggtcggtaccgtcagaatggagaaggtcgctgccctgctcggccgctcgcgcattctcacctacggcgtgttgccggtgctcggctggttctttatgagcagccccggcgcgctgacgctcggtaagctcttacctgagaagagtaaacccggctatgaagatgcgctcggcaccaccgcccatcccctcaccagcctgtttccccacgtagtgccatcagagctgtttgtctggctcggcgtggctgcgggggttaaggcactcggtctgcccgttacttcactggcgctgcgctatatcgccgccgccatgctaattggcctgatacgcgggattatcaccgagtacctgttcctgcggctcagcaggcgggggaatgcgccatgatgatttactgcgcacgtattactgccatcgggctgtttgtcgccgacggcctcaccgacaagatgctcatcaccttcgacagcaacgggccgaaggactgtctcgattactcgctgtcgctggagccgtcgttccgggaagagagcctgatgatactccccggcgaccgcctgctgctggcagggcatgattatctggtgactgccgtcggcaagggggtacagcaggcgctgtttgaactcggtcatctgacgctggtgtttgacggtgacctgaagccctgccacaccggggcgattcatctctccggcccggtgccgaaactccatgacctgcacggcaatctggtgattgaggagggacggccatgaacacggtacttattcctcccggtcccggcggctacggtaaagggctttggctgcccgttgccagcggcaaaaaggtgctgtcactgaccgggcgcgagattcatccggtggcgatagaaatcggtgcgctcactgaatcggaagtggtgaacggcttctccgatatcccgcctgataacgacatcctgtgcgtggtgattaactgcgccgggtccctgcgctgcggcctgtatccgcagaagggcatcccgaccatcaatgtgctgcccacctggcgcgcggggccgctggcgcagtttattagcgaggataactacgtctccggcgtgacgatagagcaactggttctggtggatacggccgaagcgccggacggtgaaccggagccagtgtctgtcacggcaccacggattatcaccactccgccgcctgcacgtggcgcggaaaaactggttcgcatggtcgagcgtaccggcaccgccgtcggacacgttatcgccctgctgtttgccgccagccgtgaggcggtggacgtgtcgctgcgcaacgttatcccgtttatggcctttgtctcactgctgattgccctggtgcaggaaaccgcactcggcagcctgattgcccacgccctgacgccgctggcgaactcgctgtggggactggtgctgctgtcgctcatctgcggcattccgtttctctccccggtgctcgggccgggggcagccatctcgcaggtcatcggcgtgatgattggcacccagattggcgcgggcgcgatatccccggccttcgccctgcccgcgctgttcgccatcaacgtgcaggtcggctgcgacttcgtgccggtaggtctttcgatgcaggaggcgaagccggagaccatcgcgaagggcgtccctgcctttctgctctcacgtcagttaacggggccgctggcggtcatcatcggctggctgttttccctgggcttattctgaggacatcatcatgaacaaaatcagagccgccgtggtgggtgcaggtatctacggcaaacaccatatgaacgcgtaccgccataacccggacaccgtgctggttgccatctgcgacaccgatacagaacgttgtgacgaccttgccatggcgtacgggatccagggctacacacgactggatcggttactacagcaggaggctattgatatcgtctcggtggcgacaccggatccgtaccataccgaatccatcctcaccgccctgcgccacggtcagcatgtactggcggaaaaaccgctcgccacctcagtacgcgagtgtgagcttatcgtggagatggcgcagcagcgggacctgctggtcggcgtcgatttccacaaacgctgggacccggcagtaatgcgcattaaagccgaactggaaaatccggagaccggatgcatcctgcgcggccatatcagcatggacgacgtgataacggtcccgacgcagtggctgaactgggcgggcgcaagctccccggtgtggtttctcggttcccactgctttgacctggtgcgccacctctccgggcaggaggtggtatcggtgtacgccgtcggacagaagcggctgatggtcgaatgcggcctcgacaccttcgacagcgtgcagagcctgctgacaatggccgacggcagttcgtggggggtggaaaactcatgggtgctgccggagggctttccgaaggacaacgacgggcgcatcgacattctctgcgaggcaacctatatccgcagtacttcccaacatcgcgggctggaaatcaccacgccggccttgacgctcacgcccaacagctatttcatcaactaccgcaacggcgttgccagcggctttggtatcgacccgatcaatgattttgtgcgggcggtcagacataaagccccctacccggtcaccgccgaagacgggctggcggtgagcaggatctgcgaggcggtacaccgcagccttgagagcgggaaacctgaagatgtttaaacaaacggcgcagggtagctccctgtgccagttccatatgattttgctaattctacttactggtctattcactcgtcaggctttggcccgcagatatattaatgttttccatcctgccgcaacaaaaccccacacacgattgtacgttttttagtcattaaggtgaatagcggtattttatggctatgacctttttcaccttcctgccaatagtatcatgctaaacctctcatttatgtttattgcgccaataatagtcaacaagtatttcaaaaaagtcccaagcaaattataatgctggagtttcataatgtccctttaaaaaccattttaagaagagctattatgtccctccctacaaattttaatgatattcttcgtttttttgaaaaagattacgatacagccaaagaagataatgctttaagtgcacgcggccaatttctgcaactttacccccttaatcacctaaaaaaaatgacgcttgatgactatgtcatcggcaaaggtacagcttcattttgtgcttgtgttgaagtaaaaaccagaacatgggcaaatatgcaaggtgcgacggcgctcaaatttggtatttattatggaaaatcaaaatcagatccaaccgtccgctatcgttttactcagaaatttggcgatgatgatagtactaataaagaagttttcgctaatgttaaagacgctttactagacctaatacagtcagggaaagaattagattttagagcgattgacgagaaccccctatcccaaatgtttaaggctaaaatattgagcctttactttccagaacactttataaacatttgcagcaaagatcatcttaaagaaattgctatggaaatgggtataaaagagcaacagtttattagtaaatatcaacatttgttattcaagaaaaaactagagcataaaatcacccgaaactggagcaatccaaaatatatgtccttcctttatgcccagttcatacgtaaggatcttagcagcgctcctgctgtgatagttaaaaaaccacaaaaaagaaaccatcccgaagtcaatttcgaagaaataacggacaatcgtgatttaataggcaaaaaaagcgaagaatatgcattaaactgggaaaaaaaccgcctaatcggtctcggctattcaaaactagctgaggaaatagatgatcgccgtaatcgtccaacttatggttacgactttctttcttttaatgccccaggtgatgagcgatacatcgaagttaaatcaattggccgggatggaaaagagggagcattccgttttttcctctcaggaaatgaactcaccgtttctaatttaagtaaccacagtaaaaactattatttttatcttgtacagtatgggaaagatggagagccatgcaatctatatgtaaaacatgctcaagatctttacactaatagtgaaatgtccccttgtgcttacgttgttaggttcgatctggaagaacctgcttaatagtttcgacaacctccggctcataactttaaaagtgtgaaatcaggcgcagagttccccctgcgccttcacctcagtgatgctgtaacaacacctgtgaaatcttcctcgcttcacctgccggatccgccgcatgcgtgatcgctgatcccacaatcactacatccgggcctaacagtgcgtagtccttcacagtctggctactgataccgcctgccacggcaatccgggctttccggcgcaccttcaacatcgttatcaaatcatcaatcggtttgcgccctgctgcctgctggtcggtgcctgtgtgtaccgccagcatatctgcccccgcctcctccagcaggcggactcgtgcggggagatcgtcgacgcagatcatatccaccaccacctgctttccggcctcttttgccgcgcggatgcacgactggatcgtcagcacgtcggtcacacctaacaccgtgacatagtctgccccggcgtcgaaaagcagctgcgattcaaaatggccgccatccataattttcgcatccgccagtacttccttatgcgggtatttttctttaatggctttaatcgcgttcacgccttcccgaataagaaagggtgttcccacttcaataatatcaacgtcatcaaccaccttatccataaataccatcgcttcaggcagggttaactcgtccagggcaagctgtaatttcatgttggtttccttgtgtcgaatgactattcgaggttggcgtgcagcgcaaagcctttggttaagcgatatcccgtcgactgcgccagattcacaatcatggcgtcacccagcaccatgaccgcctcttcaaacaagctgccgccgggcagaatacctttcacattctcgggtccatccggcagtttgtcggaataagccgggatcctgaccgccacccccgccagtttccccagcgtggactcggggaaaatggtcagcaaggccacagtgccacccagttgcttcgctttcgttgccacattcaccagcgaagccgtttcacccgatgcactcgccagtaacagcaggtcgcctttttgcagcgcaggcgtgaccacatcgccgacaacatgcaccttcaggccgatatgcatcaggcgcatcgcaaaagctttcagcatcaacagcgaacgccctgcgccaaaaacaaataccgctttcgcgtcagcaatggcctgctccagacgcgccagcgcagcgccatcaatccgcgacatcgcctgattcaggtcgctacaggcaacgcctgcaacagattgcgtttccatcatgcgtcctcctgacagagcgggaataaatcatcctcatactggagcatccccatgatttcccggacatagttatcgacatgccccagaaaatgaaaacgttccggtgcggcgcggtagcgctggtaaagcggcatatcgaaggtgatgccaagatgcgggttctctttgacggtggcgaatttgatgcgcggaacacgcgggtagtagtgattcttgcgcacgcagagctgcccgttctcctccacgatgtagcaggccataccgtggtaaaactgcaccgtgtcgtagtgaaccgtacagggtttatacgccagattgctgaacaccagcggcccgtcgccgatattgatggagcagtggccataattcggcggcacgataatgctctgcccctccttcacgacggccacgataagatcgtctaccaccagctcctgcggcgcggcggcaaaatccggcgacttttgcaggatatacgccgccgtacccttaattacttcatacacctccggatgggtgttgcgccgcgtgtcgttatagccgtgataatggccactggttttcttacgctccttgccaatcgtccccggcatgatgatggtgatgtcgtactgatactggtcagcagcaagccgttcctgatcctccgcaaagctgagaccgcgataaacatcgtaagccggttcattacgcagcccttcggtgaactccggtaaaaccaccgccatctgcccggcgcttttgcggccaaagccgagatagtttagcggcggtttcagcgccattacgccatcatcatcgagatacagcggcaggccgctgtggtgtagctgtttcatttttgccccctgtatacacgtcatacttcaagttgctgctacgttggctgcgcgccttcatcccggtcacatagttatctatgctcccgggaactcacgcgcttgccgccttgctacaactcgaattatttagtgtatgggttcacaatgtccggaaaccggatgcgctttaatcgcgcggatcgcctctttcagccggtcggatttcatgccaaagacgctctgaatgttgttcccgacctcaacgacgcccgccgcgccaagctgtttcagcagcgctttgtccaccagcgtcttatccgtcacgtcaatgcgcagacgtgacatgcaggcttcgatgctggtcatattccccaatccgccataggccagaatgatgccgctcaccaggtcgttctgttcgctttcctgcgccacagcggtttcttcgacttcacggcccggcgtcagcaaattccagcgacggatggcaaaggtaaacaggacgtagtacaccgcgcccatcaccagcccgaccgggaataccatgtaccagtgaggcgctcgcggcagaacgccaaagaagagatagtcgataagcccgccggagaaagagagcccgatgtgcacgctgaaccactccatcagcaggaacaccagccccgccaggacggcgtgaatgccatacagcacgggtgcaacaaacaggaaggagaactcaatcggctcggtgataccgcagacgatggaagtgatcgcgccagagagcataatgcccttcacacgcgctatgttttccgggctggcgcagcggtagatcgccagcgcaatcgccggaatacagaacatcttgatcggcgtcagcccggccataaaggttccggcggtaatcggcacctgatctttcaactgggcaaagaagataagctggtcgccatgcaccacctgcccggctttgttcacgtactcgccaaactgcagccagaacgtcggccaccagacatggttaagaccaaacgggatcagcagccgctcgacaaaaccgaacaggaaggcggacacgcccggcccctgcaccgtcatggtattcgacaggccattaatcagatgctgaaccggcggccagaccaccgccatcaccagcccgacaaacagcgcggcgaaggaggtcactatcggcacaaatcgcttgccggagaagaactccagccatgaaggaagctggatgcggtaatagcgtttatacagccaggcggcgataatcccgataatgatgccgccaaacacgccggtctgcagcgaagggatgcccagcaccatcgtgtagtcacgcacctgcgccaccgattcgggcgtgatccccagaaactggccgatggtgacgttcataatcaaaaacccggcgatcgccgacagcccggcaatgccctgatcgtcactaagtcccaccgccacgccgaccgcaaacagcagcggcaggttggcgaaaatcgcactgcccgcttccgccatcagcttcagcacgtgaaccagcccgtcagtgccgagaaacggcaggctggcgacaatattgggatcctgaaagctaacaccaaaagccagcaaaataccggcggcaggcagcatggcaatggggatcattaacgatcgcccgatgctttgtaacatttgcagaaggttgaatcttttcatctcgatctcctgagcgcgtctttatgacagggattcgcacaacagcaggttctgctccgaacaccttcagtatccgaacccgaaatgattaaaaaaacagcaaccaaagacgaaagttatttccggttttcgcttaaaaccggaaaatttatgagggcaatcacgccagataccgtcagaaagggataaaagaggaaatcgcgttcggcgggaggccatcatatgagtatcttcgaggcgcattttcgcaggctgcacgcccgctacggcgcaggtcagacgcacgaattacagatgcaggagatcgccgccatcttcggctgttcggtgcgtaattgtcgtattgcgctaaaaaagatgcatcaggaaaaatggctcgactggcagccccagcgcgggcgcggcaagcgctcacggctccatctgttaacctcgccggaaaagctgttcagccagaacgtcaataagctgctggagaagcaggattacggcaacgtgctgcggtttatcggcaacgacaagtatctgctggatcgcctgagcctgtggcgctttggggtacaggataaaagcagcgaaacgcgggtacgcatcccctactatcgcaatctggatccgcttaacccactcgtccccctgcggcggaccgaacgccaccttctgcgccagtgcctgagcggactgacgcgctatgacgccgttcagggcaggatcgtccccgatatcgcccactactggacccataacgaggactttacccgctgggagttctggctaaaatccaccgcccgctttgccgatggctgtgagctggatgccagcgccgttcagcgctgcctgctcgccgccagccagagcccgcagttcgcgccgattttcagcccaatcaaaaccattaccgctgacgccccctggcatctggtaattgaaacgcatcatccggtcagacggctcgactgcctgctcgccacccagccgacgatgctgtttgattaccagcacggacacatccgctgtaccggcgctttccacctgcaggagcacagcgacaattttatggttttgcggcgcaatcaacactggcatcaggcgcgccccggactggatgagatcaccattttcacctgggctccggagcatatcagcatgagctttattcccctgctgcggggcgaagaggtgcaggatgaccgcccgctcaacgagcgtagtctggagcagagctgctgctttgtgctgctcgacggtgacggtgcctttgcagatgaggccggaagacggtttatcaattacctgctgcaacctgtcgaactcctcagccagacgcagcttcccgacgaatacgcacgcatcctctctgtggctcagggtatgctgccgcagtggaatcaccgcccggtagattttggcgggatcacagcgccgtttaacctgcgtcagccggttattatcagcacctttcagcaaccggaactggtggagcttgccggagcaattcgccgcctgcttgaacgctggcatattcgcgccgaaatacggatcgacgcatttgaccactttaacaaccagctgcgccctcccgcggatatctggctcagcaactttatgctcgataccctttcggttccggcatttctggaatggctagcttccaccgcgctgtttacacgactgcctgaatcccagcgacaaaacctgaacgcgctgttaccgacgattctaaacagcgacgatgaacaggcgttcgctaccattgccgcctttttccatgagatgacccaccagcgatatgtcattcctttgctgcatcactggatggaatttgcgactgagaagtcatttacctggcgggatttaaatacgctgggatggccggatttcagccaactttggctcgaataatgctacgcccgcaaaagctcgctaaagggcctttaaaggcctttaagggtaagggagataagtgcgccattgtggctgtcaattcgttttgtttagctcttcctgattttcttcttgcctgggagaactggcatattttttcgtttctggatccagaggagctgcgtccggcatcagagtaacattccgcatggtacgttagatcattctgcatacccaattctgttcgtttaagtattttaggtacggctgagatagcgtggtttgaaccatcagaacaattaaaatctacacccgcaaaggctcgctttagcgagcctttgcgggcggcatttctggataattatccatgaaagcctcaccagagatgtaaaagaatccttcctgccgcggcattctctggacaatattttcccaatcttctgatgctcatgaaaccgcatactgcatcatgataataaagttatttattatcaatgaattatgcggattaaatcagcttgaccatcgcatcaacaatgctatttttacggtaactgccgcagtcctgggactgcacccgagacagccacgaccttagaggactgtgcctggctgctatgtcaggttggtcaagcccttaaccccgcaagccggacaatacggcgggggcgtctctgacgcagtccggtcgttgttgctgctataacctgtgccagtaagaggcaggttggtaccgcctctttagacggagcgtatctctgcgccagtaaacaggttgcctgaaacggcggcgcgtcactttggaggcgaagcaaaacaaagtgacgccgacgcacaccgctgcgccagccgccgtcttatcaggcttatcgttgtattaaccctctgacgccatcatttctgcgtcaaaaagataacaaggaggaatgaacagtaccggaggcggaccacgacgatccgggggcatccctgctgaggcaggcggcctgcacaccgtgcagtaccgtaccccaccatacctcaactctcgccttccggcgcaccggtattgtttagcatggcgcagctttcgctctcccatgcattccccacgcgccggaaaatattgctaccgcatcaggcggaggagtcagcatgtcgcgactggcgcaggatatgaaaaaactggcgcaccgcgcaggtggcagccacaaaaccgtccacgaccgcgaacagatggcgcagcgttttgcccgtcatttgctggcgcagaatattcaggtcaccagcacctgccagctcaaagccagacacatcgcgggatatattcatgaatggctggcgcagggtatttctctgcgaacgctacagaatgagatggcaatggtgcgctctattctggctgaagccggacgcacacaactcagccagtcagaattaatcagcaaccagtcgctcggtatcagtggtgccagctgtgacgggacgcaccgggccattccggatgcactttaccatcaggtactggaccgggttcatcatatcgacgcaggcctcgcagccagcctgcaactggcgcgggtgatggggctgcgcggtcaggaagcagtacagtgctgccagtcgctgaaaacctgggataaacagctggaaaaaggggctgaacgtctgccggtgatcttcggcaccaaaggcgggcgaccacgcatgacacaggtgacggaccgggaagcggttcgtcaggcagtgaaagaggcgcttgggattgccggggagcgtaacgggcatctcattgacaagccggatctgaaatctgcaatggactactggcacaaccatctccgcgataccgggctgacgggggaatactctccccactccctgcgctatgcctgggcgcaggatgcgatccgctattacgaagagcagggtctgagccataaagaggcgctggcggtaacttcaacggatctgggccatggtgatgggcggggaatatatattgagcaggtatacgggtatactgattgaatctcactaatacaagatgtttcattcctttttgtatgtaaaaattcataactactttaaaattttaaatgcacaataaaagtatagatagataatgtgtactgtttccatttcaccgcacttgagtttaaaataccaagattcatctaaaaccaagattgtgtcatgaaaatttcatatttaaaatcatctccgtcaatgattgaagttttaaaaaataactatgaagcatttataattcaaaactataaattcaatcacttaggtttatttcatgacgaagacagtatttatgctgtaatacagaattacaaagaatctaatactacgttagatgaaatacaagaactttacaactacagatttaaaaccgcaggtgttccgggaccaacgtttacagaagaagtaaaagacaactatataaaaatagatcttagaaatacatatgaaaaagtaagtttatttggccaaccatttaacgcattcgaatttaataataacatacgcatagccataccatctaaatttcatccttttcatgttgacatgaagtggtccgacaacagttttacatttaccttcaataaagaacttactcctaatgatattgatgaaatcattttaatatgtgaaagcttaggtttttatggttataaatacaatattaaaacagaccatgaactacctgattataatcatcaaataaagaaaagtaatacacaaggaaatcttacattagttgcgagtcaataccttaggaataatcaacctaaagaaatcttggagaaatatgaagaggatcaagacttttggacagaaaaaagagccaatattttttcagatgtcaatctaaccaaggatgaatgtcttattgattcattcagaaagagtcaaaacagatgctttgtcgatgccagtgtatttccacgaaataacataagagaatatatatcactgtatgacactgtaatcattgcaattccattagcagattcacccaatagtcagagtttttatgacatttttaaaataagcaagattgagctgttagagttagttcgacgtggacgtataaaattcgtcgcattccaaaatctccagcggtatgattcaaattttttggcggatgttctgtctgttgatccagaatgtgtattattttcaagaagattagccgccgcgacattattagcaattagagaaaaaacaggattatttggattcgcatttgatagcagcactcaatataacttattgaaagaatgctacaattcaaaagtcgatgcacttaaaatattagcagagtcgttatcggaaaatatagcattttttgagtatggcataaatcaaagaggtgcattgggtattagtcaattttgtggggcaagctttgcagcccaaatatataaatcacgcggtcgcgattatggtattgagctaatgacaagcgcaatgtcacttgagttctcactagggctaggggcacatcactttccctttgagcacacaggttattctgaggtaaatgcctgtaaaatccttaatggcatatataatggagttcagcaatcacaaaatgaacttcgagaaatggagatacagactttactatcaaatattttcactattaataacgacatgaatgttctcgagttagatgacatcttaagcaaatacagtcgacgtatgatcccacaaatattacaagagtatgcccatctgacacctgaagaattaagctttaagatatactctctaaataaagatattaaagcaattgaaaagaggaagcaaaacttgtctattttagacttgtcaggttttgccccagtagttgcaggggcagtaatggagtataagggactatcgggagcgggttatattgcgttgctaccatggattttcaaattattaaaagtcaccaccaataattcaaagatattcagcaatgaaatatttagtaatttagaagctttaactttaaatactccaagaaacacaatgttggtacataaaataagacaagacatgcctaaatagtacgttttaattcgatgcattatactatttgcacatcaaccaagcccatacgaatatatgggccataacgatgctttcacaggtatggccatttatttggcaaattttaaatcagatcgtttaatctttttttctagtatagcaactatttctcttaacttttttataagttcaataatcgccctacattgcatccatcacaaataaaatgaattgagaatgagttcattgaaaaaatctcatcaattcataatgtaatttagtgatcttttgaagaataaccctcgatctctataacaacttctaaagtatacccaccattctggcttgcaaaatcctctttggtaatagacacatagcgattatctttctttatcataactgggatcttactaaatagctcattaatattaaagtcatcatcccctaatgcttttgatattaattcttccgcaagcaatgaaatggtattttttgaacaatttgatatgggtgaattatttatattagctcttaacttgagtttcttagcagcatattcatctccatataaataatatgcaacactatcacgaaataaaccatcattaccaatctcaatcatatgactacatgatatccaagtatcaaaactgaaatgataatcattggtgtcaactccttttccaacaagaaaatctttggctaagaatggtgaccacccatatttattatctacttcgggtggattagattcgatttttttccgtaattttacgtcttttaaacttgccttaattccttctttcgtcttaatttcattaatatgtatgtttcttacccagcgattaagagcatcaagatctgttctaaagaagcaaatcgctaatttttttgcataattaaacagagcctcatcgtcaaaatatatttttaatcctaataacttagtttcataagcttgataaaggtaaagcatataaataaatggcataaacgaaaatgataataaaactggcgtcagaagttcagtaagattagcccaagaaaacgttaccgaaggcgacataattgaaacaaaaaatgaatgggcaaaataaaatataacgaaaacgcctagcactacctttatcgtcgctccgattttttctgtttcttttttcgtattagctacgacagccagcaaccctaaaaaaagcataatagggtatattataaactctatagcaaaggaaaaactttgtagttcaagaataaatgtaagtagagcacttaatccaatcgtttctttgatttgtgatttaaaataatacttactgctctttattttatgtgtttcaaagattgttacgaaagcatatgtaattacccataccaaagtggtcttaagattatctgtactccaaacaccaatttcataaaaaagcacaatacaaatagacgtccaaacaaccgcaaatcctaatactgtcaaaatttgtttatggaaaaatgttttgataagttgataaaaagaatctctaatatcctttttacaccaaagcagagcaatgattattaacatccatataacaaaagcatactctctactattaatgtccatttagtcaccattactcagttaaattcatttcaaagttacattttatcaagcctttatcattttaaactgaattacggtaggcgtaccaactttgtataagatagaatacaacaagcttcatgcttcttttttagatagtttgttgttcgtgcctatcgtacactttgcgactgttcgttttgcatctattccaagcatcaatcaatacaataaatttcagcaccataaagataataataaaaatcaacaagatacgaaaaccccttccatatcaacatcatcaccaccctttttgcgccttcccttccccgcaaaaaataaaaatctccaacaaactcaaccatctcccccaccaattacaaggacgccagccactttttagttgtttgaagttcaatgaagtctactaagcccgcacagcacaagctctgcgggcttttttacgtctattgtcgtccagtgagaattgctgagaactacgagttatggcaccctgaatgagacccactaagaagggtccaaaaatcgagggtcccaaatggcaaaaatcgctaagaagctcactgacactgaaatcaaaagcactaagccagccgataaagaaatcaacttgtttgacggtgatggtctgattctacgaatcgctcctttggcgaagggagggaagaaaaattggtatttcagatatgcagtgcctgtgaccaaaaagcgaactaaggtgagcttaggaacctatcctcatcttacacttgccaaggcacgagctttacgtgatgaatacttgtcgttgcttgcaaatggtatagacccactagttcataacacccagaaagccaatgccctaaaagatgcaacggaacatacatttcaagcagtagccaagaagtggcttgatgagaaagtcaaaacgtcaggcatctcccgggaccatgctaacgacatctggcgaagtcttgaacgaaatattttccccggtctgggtaatgtgccaatcaatgagatccgtcccaagctcttaaaacagcatcttgatccaattgaacaacgaggagtactggaaactttgcgacggctcatttccaggttgaatgaaatcttccgttgggcggctacagaagagctgacccgcagataatctgggccaacgtttcagtaagcctaaaaagcagaatatgccagccctacccccctctgaactccctcgttttctggcagcactgaacaatgcatctgtccgtttagaaacaagactactgattgaatggcaatataaacagacccgttttagttccaggcattttttgagatcccggtcaaatgattgtgttgccgatattcctccggcgtcatattgttcagtgattcatgagggcgttcacagttatattctgacacccatctttccgtgatttcccgcacttcattcagcgttctgaacagataaaaatcgagtatttctgtacagtatgttcggttaaagcgctcaataaaagcgttctgcgtcggcttacccggctaaataaattccagttttactgcatgttgctctgcccattcagccagtgcaagtgagataaattccggaccattatccatgcgtagcatgaccggatagccgcgatttgccgcgatcctgtcgagtacacggaccacgcgcaaggctggcagattcagatcgatttcaatcgacaatgcctcacggttaaagtcatcaacgacattgaacgtgcgaaaacgacggccacagaccagggcatcatgcataaaatcgacagaccagctctggttcagcgcttccggcgtggccagtggcgaggggttacgcaccggcagccgttgtttgcccttacggcgaaaatccagcttcagcagacaataaatacggtggatccttttgtgattccacatgtatccctgccgccgcagaacctgaaaaagcttcggaaaaccgtatcgtggataccgttcagctgccgcctgcaatgcggtaataacgggttcgtcacgtgtgttatccggacggtaatgataaaccgttctgctcaggttcaggctccggcaggcctgacggatactgagtccgaatgccgttatcagatgagtgaccagctcacgcttaaaggctggttttaaagctttttttcgataacgtctttcagcgcccggttctcaaggctcaggtcggcaaacatctgtttgaggcgtcggttctcgtcctcaagatcttttatctttttaatatcagaaggttccatgccgccgtatctggacttccagttatagtaggtggcttcagatataccggcctcccggcaggcatctttaacggttcgtccggcttcaaccgatttaattacggcaatgatctgatgctcggtaaaacgggctttacgcatagcgatctcctttgttggcagattgattatgccggaggatctctaaatgtgaatggcacgattatgcgggatacttacaatggggcgtggaaaagactcttaggtaattgttgtctgttgtaggacatagcggcaggttaagcagtgaaattaggaatagttagcttggagttagatgcagacgttcttcagatactatttcagattcagttcgtgcatgtctgcagtaacttctgcaatattaccagcagacagtgagcaaatgtgtgtctaggcatagaatccgcatctccccacgcctgcgggacagtatccagagcggactaagttacttagatatctggctggcaacggaaacggtgagaacaatataaaaatgcatttatcaaatttaaataaaatgattgcttattttcccattactaatgagcgcccaacagggcgcttgtgaatcaggtcagatatggccgatctttactgacatcaaacaagtccaagaaaaatgtatcgcctatccgaatattagaaccaatctttacattagtagagttgttgcagaagaaatcaaagtgatatcttggatgcactttacccctagcatttttaagatcatcgtcaaatctgaagtatccgtgatcaactaaaagcaatgaagaaattgcatcacaataatttattgcctgctgaatatctctatcaaagttatcacataattctacagcaatggcctcgtaagaaaaggagccattaccgcaagtagcaattacatttctgcatcgggaaataaattcagcattaacaggaagagcataagcatcataattaaagcagatattgctttcatactcgattacctgaaaaggtaagttcatagtaaaaaaaccatctgttttttttaccaatatacgcttatgtgtacctgtgcttattaataaatcgaaatcctttgtttctttattccaggactcatgacatgtgtttaatatctctgcggtaacaagcagattttctaggttagaaaatgcatcccttacagcacaaaacttgtcaagatattctgctggcacgttattgaaaaagtaaaggctcatagttttttgttcctttcatattctatttcaatcaagcctttaatgtattccccgtcagcatcatcatcttccgcaattatcctttcgactcgatcagttatttttgctattagtcgaggtgtagacttcttgtctgcgcaataacttttaaccatctgagaaattgaaaccgactcatctagaacaataaaatctttttgactttgtatttcttcatctgaaggaagccttacatccatgtagttgttttcattgagaaagttcagaccttcgagaattgtagggattgccggattttcattatcattatttaaaactaagtgactttctaaaaatgacctcgccatcatagtgtagagtgcatttcgaaaattagctctcttcaccagtttcatggcaaaacaaataacaaatggaaattcaagaccttttgcattatttatattagaaataaaaagtttaccatcttgctttgattttgtttcatgtgagatatttgaatcccacccaagctgttgttttacttttgattttagcgaatgaatgtactcataaatataaccaccggcgtcaagaaaaataacagcaatatctccttgctctaaagatggattgcgttccttaatatcgattataatatcaactattttatctggcccattatctgttccttctaacaaatgaacagcagtacttttatgatttttgggaatatcttcaaaacgcctcaaagggtctcttgataaatggactctatctcctacttttttatatttatacccacaagaatcccattcaggctcttttaaccaacgcagaacaggttcctcgtagagtcccattcctaaggcatgagaaaacatcaaattcttaggatctgtgcggtagcattttttaagaacgatatctgctcgattcacgttatcgctaatcggcatgaaaatattttggaaaacgtcacctgctacatataattttttagaagtaaccatttcacagagatcaatgaagctttgtgggaagtcttgactttcgtcgataaatacgtaatcaagtgcctttttatcagctctcccactattatttatatctgcaatggctttcttacatagggcatcaaaatcgccattaccaaatcccccaaatggaatttcgtaataatggcatatatatctgtacattccagaaaaaggttctttagtcaaaccccaagagttgaagcaaaaaagttttgtaccccattctatctgtttttcgactcgcataaaatcgaaaaactcagggattctggttctcattgtggaagcgagaattttattaaagcaagtaaatgcaattctagaatcagggttttttgaataaatctcttttaatttgtgtaaaagtaattcagttttacctgaaccagctaatccttgtattacactcttttttccaaagccactctggaagacaaactttgtttgatccgtatcaaataaaataattttggattttattgtatctaataaattatttgcttcaaggttaattcttgatgtgtcgttaatactaccaacaataagtgagataattaaatcaatcaccctactttctttagtttcgacttccagttttttgaaatcgatatcattacgagaaagcgattcaaataaaatttgccacgattttttcctgccgatcttatctcgatacttgaatttctccgctaaataagaaacatcttcgagaaaatcttcctgatactcctcaaaaagatcatcgtcatccccaaaatctataaaaaaaggttttataccagaagaaaatactgcaatcgctcggtcataatcatactttacatcctcattagatagaggtctgcaaagaatatatgtttgttttttatgctgctcagcatagctgtttattattacatcaacaccagcactttgagccagagctaatgcatcctgagagtaaaagcagtagttggacattaaacttcctctttagcgggttgtctactcatttcaaattcttagttgtgtgctgtgcgagctaatgactgtctttgttctgaatcatactctttacacagaaaaaaaacactttgcagcttcgttaaggtggctcgcgttccgataaactttagcctgctctgcaatgtcgtatcgtaagttattcgttgggatgagagggtaaacctacctgatcttacccagcaatagtggacacgcgactaagtgagtaaactctcaagtaagaggtgactcacatgacaaaaccagcattaaccaccaaaaagccacgcaagcagcacacgcctgaatttcgtcaggaagccctgaaactggctaagcgcattggtgttgccgctgcagcccgtgagctcagcctgtataaatcacagctccacaactggcgaagcaaacagcaaaatcagctctcttcttctgaacgcgagcaggagatgtccgctgagatcgcccgtctgaaacgtcaactggcagaacgggatgaggaactggccattctccagaaggccgcgacatacttcgcgaagcgcctgaaatgaagtatgtcttcatcgaaaaacatcaggctgagttcaatatcaaagccatgtgccgtgtatttcaggttgcccgtagcggctggtacgtctggcatcagcgtcgtcatcagataaaccggcgtcagcggttccgccttgtctgtgataacgtcgtccgggaagcattcagtgacgcaaaacaacgctatggtgcgccacgcctgacggatgagcttcgtgctcagggttaccagttcaacgtgaaaaccgtggcggccagcctgcgtcggcaggggctgcgggcgaaagcctcgcgccggttccgtccggtcagttaccgcaaacatggtctgccagtctcagagaatctgctgaagcaggacttttacgccagcggcccgaatcagaagtgggtgggtgacatcacgtatcttcgcactggtgaaggctggctttatctggccgtggttatcgatctgtggccgcggtcagtcattggctggtcgatgtcctcgcggatgacagcacagcttgcctgcaatgcgttacagatggcgctgtggcagcgtaaatgtccggaaaatgtcatcgtgcatacagacagaggcggtcagtactgttcaacggattaccagagcttactgaaacgccataatctgcggggaagtatgagcgccagaggttgttgttacgacaatgcctgtgcggaaagcttcttccatacgctgagggtggaatgtatccacggagaggactttgtcagccgggaaataatgcggacagcagtgtttaattatagtgagtgtgattacaatcggtggcgtcgtcacagtgcctgtggcggtctcagtccggaacaatttgaaaaccagaacctcgcttagggttgtgcccatattacgcgggtaggatcaagcttccttcagtcttttggggatcataccgtgcaccttatagggatttcacggtaatatttagtaatgctcaagttcttttatttttagatttcataaagatagaaaccataacattaaaggggggtactaacacgaccaattaacttattatgcaccttttccactgcacccgttttcccccatatagcttcagcattgcatcagcaaagctgtcatccagcgcgtagaattaaccttcaggcaaattgagaacttcagcaaatcgacaaaccagttcgaagtgagttgggttatcaacccacaaatagcattaaattagacactatgtaaaacttggaacccctacagtatcacagaaggcgttggcgtacccattgagccaaatttgagccttcataaaaggcctggtaaattttgggattattgggatcgatagctacggcctcttacatcgcttcaactcgttcggcaagcatgaatgaagagtaatcatcaccagacgacaatagtgtaactgccctctttcctggactgttccggtatcccaggagaaagtactttatcagtgttcatctctcttatgatgcccgtgaacccaaatgcgtcgcggaacctacttttaccttcttctgacaagagcaagagtctggcacgatgaataccttccatgacctccgttcattaggtcccctccggtagccccctaagttttacttttctcacggaattttttattaccgtaggcgttattcagcgtagtccgaagacgtgatcctgctcacccagtcaaacataacttgcatatgattgccattggatgtcctcacaccaacctgacacgcatttacgcctgtcgttttgccagtcaaaacctgtccatacttcatatagattttgataccgactccctgtttatagcacttattgcaaatcgagaaataatctcttcttgatggagtatattgctgaagattaaatccgtcagccggcaccagcgaaagattaaaagcgtcattacctgataattcttcaagaattgccagagactctagtttaacttcaatgcgcttatttcctttaggtttatccgaagccagaatcaaattttccttcggattaaacttcgcaatgtagcctgtgattatccgggcattattactcaccaatcgaacagggatatcattaaaacgtagaaattgaactcgacgagcaagcatagaataatcccgcggccatatttcagcttctcgcccgtaggaaatatcatttacagccatacattccataaatatatattcatctatgctaaatgaaaaagccccgaattcacggggctgaataaaacgaaataaattaacgtaacagagacagcacgttctgcgggacctggttagcctgcgccagaacggaagtaccggcctgctgcagaatctgcgcgcgagacatgttggaaacttcggtcgcgtagtcggaatcttcgatacggctacgcgcttcagacagattgtttacggtattgcccaggttggtgatagcagagttgaaacggttttgtaccgcacccagatcagagcgcagcgcatccacctgcgccagcgcggcatcaattttctgcagcgggttttcggtggttttagcggctgcttccgccagctctggttgtgctttgaaatcatgaccagcggctttgctggcattgtaggttttaccgtcgatagtaacgacttcggttttaccgtctacgccacccagttggttagccgctgttttggtagtgccgtcagcagcagtataacttgtagttttagctttaattgctcctgtcgcttcatcgtaatctgcggcgtaatacttatcgccagctttaagcgcataaccgccttcaattgtcttaccatttttatcggtataagacattttgaccaactcagcgccattagcatcggtagcgtcaacgccgccagcaattaaggcatttttagcatctgctgaaacaactgccggtgtatcttttaactcctgtacttctgttttagttgtcgcaccagcaggcattgtggttttagttgcgccagccgcaagggttactgtaccgtcagtagcaacgttaacttcataatcgccatttttggcggcatcagcaccagtaaagccaccaatagtaacaaagtacttgttattatctgcgtcaaatttaaccgcaccaccggttacagaagccgtaccattcgtaccacccgtagccgctttaatagctgcatcatcaagacccgatacatccagtgtagtaccattattggcataagctttcgttgttactgctgtatctttcacatcatacgctttctgcacgttcagtgagtccagacccagggtctgagagttgatctgcttcagatcgatatcgatagtttcaccgtcgttggcgccaacctggatggtcagggtgttgtcctgcgccaggactttcacgccgttgaactgagtctggccggatacacggtcgatttcgttcaggcgctgggtgatttcagcctggatggagtcgaggtcagactgggagttggtgctgttagcagactgaaccgccagttcacgcacacgctgcaggttgttgttgatttcgttcagcgcgccttcagtggtctgcgcaatggagataccgtcgttagcgttacgggaagcctgagtcagacctttgatgttcgcggtgaaacggttagcaatcgcctgacctgccgcatcgtctttcgcgctgttgatacgcagaccagaagacagacgctcgatagcggtgcccagtgcggactgggatttgttcaggttattctgggtcagcagcgacagactgttagtgttgattacttgtgccataaaattttccttttggaaggtttttgataaagcaatcctccatgagaaaagcgactaaaattcttccttatctgatgtaaaggagaaaatcatggctactattgggtatattcgggtgtcaacaattgaccaaaatatcgatttacagcgtaatgcgcttactagtgcaaattgtgaccgcatttttgaggaccgtatcagtggcaagattgcaaaccgccccggcctgaaacgagcgttaaagtatgtaaataaaggcgatactcttgtcgtctggaaattagacagactgggccgcagcgtgaaaaacctggtggcgttaatatcagaattacatgaacgtggagctcacttccattctttaaccgatagtattgataccagtagcgcgatggggcgattcttttttcatgtaatgtcagcactggccgagatggagcgagaattaattgtcgagcgaacccttgccggactggctgccgccagagcgcaaggacgactgggagggcgccctcgggcgatcaacaaacatgaacaggaacagattagtcggctattagagaaaggccatcctcggcagcaactagctattatttttggtattggcgtatctaccttatacagatattttccggcaagccgcataaaaaaacgaatgaattaaaataaaaattacaacaggatggatataacatttttgtaatacaggcgtgtggcataaataaaccgaaagggtatacaaaaaagacagcatctaattaaaaagagaaaaaattcaacgtattaacatatatagtgtaacgcgctcacgataaggcctatgttacatccagctatagacgacatcgctcaaaacactaccagacacagtattcacctggaaaggctttttaatcaaaatgttagatgtaagcaattacggacagaaaaaatagtaaagtttatgcctcaagtgtcgataacctggatgacacaggtaagcctggcataacattggttatcaaaaaccttggttttcaagaaccaataaatcgtgtggctgatgcgctataaaaatcgcagagcggtgacgatattccgcataaggagctgttcgttcgcaacattcgaacggtgacgttaaagccggtttcattggctaatgaagacgaaggggacaaaattcctacagagttgataccacagagatagtccaggctcgcaggtgatacgggatttaacgccggaaagtctgcacagaacacgatctgccgccggacaccattaaattgccccgcaacgtgttatcaatactactccctacgtttcccgttaccttgctgtcggtacgtttacctcattgtctgaaaggttatttgcgaagttatcattaataatccacgggcgtctggtatgcgaatccagttccccaatcctggcgctttgcctgtgcgaccatacgcgcgtaaataagcctgaaaccaaacttcaccgcttaacgctctcatctttcccgatttttacgcaaaaaatcatcacatgatcaagtgtcatattagttattgcattttacaaatgatattggtaattattatcattctcattaacgacttgttcgatttatgacgtggagagagaggatttctcatgcgtattctgtttgtcggtccaccactgtatggactgctataccctgtgctgtctctggcgcaagcgtttcgtgttaatggccatgaagtactgattgcaagcggtggcaaatttgcacagaaagcagccgaagctgggttggtggtatttgacgctgcgcctggtttcgattcggaagcgggttatcgccgtcaggaggcattacgaaaagaaaataacattggaacaaaaatggggaacttctcattcttcagcgaagagatgactgacccgctggtcgcgttcgccgggcagtggcgaccagatctcatcgtctaccctccccttggggtcgttggaccactgattgccgctaagtatgacattccggtagtgatgcaaaccgtcggcttcggtcatacgccctggcacatcaaaggcgtgacgaaatcactttctaacgcctaccgccgccatggggtcagcgcgccaccaagagatctggcgtggatagacgtcacaccgcccagcatgagcatactgcaaaatgacggagagccggttatctccatgcaatacgtcccgtataacggcggcgccgtctgggaagaatggtgggaacgtacacctgatcgcaagcgtcttctggtcagcctcggcaccgtcaaaccgatggtggatggcctggatctgatttcctgggtaatggattctgccggcgaagtagatgccgaaatcatcctgcatcttccggcaaacgcccgctcggatttacgttcactgccgccgaatgtccgtctggtcgactggcttccgatgggcgttttccttaacggcgccgacggttttatccaccatggcggcgcaggcaacaccctgacggcgctgcatgccggcattccgcagatagtctttggccagggtgccgacagacccgtcaatgcccgcgccgtggtcgagcgcggatgcggcattattcccggtaagagcgggcttacgagcagcatgattaataccttcctcggtaatcgcgcgcttcgcgaggcgtcgcaggaggtcgcggcggaaatggcggcccagccttgcccgaccgaggtggcaaaaaaactgatcgccatgctgcaacacggctaaccgcggcagcgcaatgacaatatggcggctgaacccagcgtgtgtcgccatatctcatctttcaccgataaggaggcttaatgcccgcgactcattcccccatgcccgctcgtgcctggatagttcgccttgcccgcgtgtgttgggaacgtaaaacactgagcatcattgtcatcgtagcatcagtatcgaccattttactggctgcgctgacgccgctaataacgcgtcaggccgtcaatgacgcgatagcaggcgatacgacccacctgccgttacttgcctgcggcctgctgttaattgccctttttgattttatcgggaattacgtgcgccgcggctatgccggagaactctcgctgtgggttcagcatacgttacgtagccgtgcgttcgacagtattcaaaaactggacggcgcaggccaggacgccttgcgtaccgggcaggtcatttcgcgtaccaacagcgatcttcaacaggtacacaccttgctacaaatgtgcccggtgccgctggcggtactcacttactatgtggccggtatcgcggtgatgctatggatgtcgccatccatgacgcttatcgtgatttgcgtactggccgcccttgccattaccgccctgcgcgcccgtcgccgtgttttcgcgcaaacggggcttgcctcagaccggctggcgcacatgacggaacatatgcgcgaagtattggaacagatctcagtggtgaagtcctgcgtggcggagttgcgcgaaacgcgttggctcgatggtcagtcgcggcagatggtgcgggtacgcatcggcgccgctatctcgcaggcgatgccgggcgcaaccatgctggcgctaccggtgatagggcaaatcgtcctgctgtgctatggcggctggtcggtaatgaatgggcgcatcgatctgggaaccttcgttgcgttcgcgagttttctcgctatgctgaccggccctacccgcgtactggcatcgtttttggttatcgcacagcgcacacaggcgtcggtggagcgcgtcttcgcgcttatcgacacgcgttctcgcatggaagacggtactgagtcggttgaaggtcagattatcgggctggacgtggagaagatgagtttccactacgacaacggtaaccgtatcctcaatgagatctcgttttccattcacgccggtgaaaccgtggcagtggttggcgcctccggctccggaaaatcaacattgctgatgttgctggcgcgcttttacgatcccacctccggcggggtgtggctcaacaccactgcgggtcaacagaatattcgcgacctgaaactgacggcgcttcgtcgtcgcgttggcgtagtttttgaagacgcgtttctgtttgccggtacggtggcggaaaacatcgcctatgggcacccgcaagcgactcaggacgacattcgacgcgccgccgatgccgcaggcgccagcgggttcatcaatgcgctaccgcaggggttcaacacccgactggccgaacgcggaagcaacctctccggcggccaacgccagcgtattgcgctagcccgggcactgattaccgcgccggaactgctgattctcgatgacaccacctcggcggtcgatgccggtactgaagcggaaattaacacggctcttggtcgttatgccgataatgagcatatgctgctggtgattgcacgccgccgttcaacactgcagttagccgatcggatcgtcgtgctggataaaggccgcgtcgtggatatcggtacccaggcggagctggatgcaaggtgtccgacgtttcgctcgctgatgagcggcgagggggattttctcgcccttgccccggcagaacaacgtacgctatggccaacaacgcaggcggtaaaatccgacgacgcgcatgagcgccagacacccgccggaaaaggttttgtcgaccggatgacgcgcgttccagaacgcgccgtacagatggcgctggcaggccacgggcgtcaagtctcatcgctgctgacgccagtagcctggatgttcgtcatcgccgccctgcttatcgcgcttgattccgccgcaggcgttggcgtgctggtgcttttgcagcgcggtattgactcaggcgttgccgcaggggatatgtcgactattggcatatgcgccctgctcgcgctgtgcctggtggcgatcggttggtgctgctatgcgctgcaaacgatcttcgccgcccgcgcggcagagtcggtacagcatacggtacgcttacgcagcttcagccacctgctacgcctgagtcttccctggcacgagaagcacatcgactcgcgtcttactcgcatgaccgtcgacgttgattcactcgcccgatttctgcaaaacggtcttgccagcgcggccaccagcatcgtgacgatggtcgctatcgccgcggcaatgttctggcttgaccccattcttgcgttaacggcattaagcgccgtgcctgtagtgatgctggcgacgtggatttaccgccgtttgagctcgcctgcctacgcccaggcacggctggaaattggtaaggtgaacagtacgcttcaggaaaaggtctccggtatgcgggtagttcagtcacacggccaacaacagcaggaagccgccaggctacgggcgttatcagacaacttccgcgccacccgcgtgcgggcgcaaaaataccttgccgtttattttccgttcctgaccttctgcaccgaggctgcctatgccgccgtgcttttaatcggggcgagccgggtcgccggaggcgaaatgacgcccgggatactggcggcgttcttcctgctactgggacaattttatggcccggtacagcagttgtcaggcattgttgattcctggcagcaggcgaccgccagcggcaaacatatcaatgcgctattggcgactgaggaaacggagaatattgaaccgtcctccataacacctggcactggcgcgctacgtctggaggcattgacattcctctatcccgaaaaaacgcaacctgtgcttgataatctctcgctcattattccgccaggaacggtagtcgcggtggtcggacgtagcggcgctggcaaatcgacgctgatcaagctgctggccgggctctactctcccggtagcggacaaatccgtgtcggtgagcgcttaattgatgccgcgtcgcttagtgattatcgtcgccagacggggctggtcactcaggatgtcgcattatttagcggcgatattgccgaaaatatccgctatccgcggccagacagcagcgacacggaggtggagagcgcggcgcgacgggcgggactctttgaaactgtgcaacatctgccgctggggtttcgtactccggtcaataacggcggcacggatctgtccgcgggccagcgtcagttgattgccctcgcccgcgcccacctggcgcaggcgcatattctgctgctcgacgaggcgacagcgcgtatcgaccgtagcgccgaggagcgcttaatgacctcgctgaccagggtgacgcataccgagaaacgcatcgcgcttatcgtcgcgcaccggctgaccaccgctcgccgctgcgatgtgattgtcgtaatcgataaaggatgtatcgctgaatatggcagccatgagcagttgatagcggctcatggcctgtatgctcgtctgtggcggaacagcatcggccagacacgcgatacgcaaggagaggtcataggatagtttttatcgccacgatttacgcaaaagaaagcccgcaagcggctgttcatgtaacagccgctttagctattgatactgaccgaaatataaacgagatggaatacaaagaatgagactgagcccgcccgtcgctcctgtcgctatacagaccgctacgcgccttcgccgtcaactcgccgccggaagccaggttgacgcttctcacttctggcgagaagcaaactcgctcgcactgccgctggtgacagccattaacggcgcagacgatgaacgggaagtcaccttcctgtggcgtgccgcctctcctctgcggggggtttatgttcgcctgaaccgtgtcaccgataaagataacgtggcgaaaggtatgatgacgcaactgcccacaacggatatctggcatctgacgcttcgcttaccggcgtcctactgcggttcctatacgatggtcgaaataccaccggaaaccccgggcgagacggtgttgcagcttggaagccgtttcgcctcccttgtcgggaaggcggatccgctgaacagcgcgccgggaataaatgttcggggcaatgcgcaggaatccgttctggcgctggatcatgccccggcacaggaggagtggtcaggctgtcgcgcttacgccgggcagcttttcacctcagagcatcggctcgccggacaacgtcgccgtgtgcggctgtatcttcctgacgttcctgtcgtacaaccgctgggcttgctggtactcacggatggcgagatctggttcgaccatcttggggtaagcgccgccattgacgccgccatccgcagcggacgcatcgcgccggtggccgtactcggcattgataacatcaacgcgcgtgaacgcgtcgcaatactcggcggtcgccgcgagctggtgctcgacattgccgaacgcctgctgccaacccttcgcgccaaatacccggaacggcggtgggcggaccgtacacaaacggtgctggcagggcaaagccttggcggcgtgaccgcgctgatggcggcccgccacgcgccagagagcttcggcctggtgctgagccactccccctcaatgtggtggacgccggacaaccgcaaccgcccgaaccatttcagcgcagaagagcgctcatgggtcagcgaacatgtgttatccgcgccctcgccagccgtacgtacgcatctgtgcgtgggatcgctggaaggttcgacggtcccgcaggtcaaacagttgcatgaaaaattgcgcgccgccggcgtcgaaagccattacagcgtgtacaccggcggtcacgattatgcctggtggcgcggcgcgctgattgacggattacgtctactgccccgataaaacttcacctgccaaaaaggaataacatccgatgtatggtcgccagtaccacaacaagcgctatcgcatggcgctatttttagtgagtttttgttttagcgcgctgagttatgcgcagccggatatgcagccattagggccgaatatcgctgataaaggttcgggatattaccatttcagggtcaatgactttcaatctgccgatggcgcaagacattaccgggtatggaccgctatccccaataaagccgccccgccgtcgggttatcctgtcttatatatgctggacggcaacgcagtgatggacagactgccggagacgctgctcaaacagctggcagaccactcgccgccggtgattgtagcgattggctatcagactaacctgccgtttgatcttaacggcagagcttatgactatacgccggcgccgggaatcgatcgcgatgacagtgaaaataacccgcgttttcatcgtaaaaccggcggcgggccagcgttccgccagctactggagagacatatcgcgccgcaggtggaacaaggaataaccatcaactccgaacggcgcggggtatggggacattcttatggcggcctgttcgttttagactcctggctgtcgtcatccttctttcatatctattacagcgccagcccgtcactcagcagggataactttgtcctgttgaatcgccttacgacagtgaagccgtcgctgttctgccataaaaaactcatcataatggaaggttcagcgtcgaatggggatagcaggcaacgccagatggccgagctcctacaaaaagttcaggagaccgtgagaacgcttgagaacaacggcgttaacgcggccctgcagcattacccgggcctgggccacgggcccatgtttaacgcctcttttcgcagtgcattgctggatatcagtcgcgaaccggcaagccaaaaaccacgctgccattaacccgccgccagaatatgcccgccagcggcgggcataatccatcaaaacgaggccgtcacaccggcataataagcccgccccggttcgttataggtatttgccccttcggcggagcgatagatctgtttatcgaagatattgctgataccgacattaagacgcaggttcttattgatatcgtagttaacgttagcgccgaccagtgagtaagcccccagcgctttcccggacaatcctttggtctcttcactacgcgactccgcatgtgttcgcggtttttgcttgccgtataacgtccagttgacgttagcggagagcgcgctggtgatagtccagtcgaggaaggtattcaccgtatatttcgggattatcgataagggattgccggtatctttttgctcagaagcaatcatataagtcgcattggtattccagttcagacggtccggcatcagcggaacagccatgctggcttcaataccttcaatcagcgctttaccgccgttctgccactgcaatacataagcgccagatgcgcttctgccaataatctgatcacctgcgacaatcttattctgataatcgttacggaaatacgttacgcttgcgtgataatcgtctacggtaaattccagcccaatctctttattgatactaatttcaggatcgaggttcttattaccaaccaggtaacagccgcccgacgtaatatcttttggacaaccgttgcctttcgaatagagtaaatacccctcactggtttgatacaagttcggagccttaaaggcacgggcaataccggctttcaccttgacgtattcacctaactcctgggaaaggttaagactgggactaaaattactcccggattcgctcaaatagtcaaaacgcagacccggaataatattggtaccggccataggttcgatattatcttcaacgtacagcgcactgatttccgatttatttttgctgctacggttagccgccgaaccgggaatcccggcgatattgctatccttaaccgtcagactggtagaggaaggatcgttcagctcatcgcggttccactccgcgccgacggtgagcgtttgctcaaatagccatatcaccgggacattcacctcgccgctggtgcgatacgaggtcaggcggttagtggtgaacgtctggtcgttggtaatacgcccctcgccgccgccggagagcccctcattcatgcgggtgttatcggttttttcatagtagaaccccaggcggctttgcccccagtcccagatgccgttatgagttagaccgtaattctgccggtacaggcgattggtctcccgcccggactgcgccagacttttggtaaccgcgtttgaagtactgttttgcgtatcgccagcataaatattcccctgccgactatatcccgcttcaaaatcaaggatttgctgcggggtcattttccatgagaagacgctattaatatctttattggtgaccccctcccgtccggcggcatttttggtaccggcggaggagttaatatcccagctatcggcatcggttctgttgagattaccgtacaggcgcatcgtcaacgtatcaccagccaacggaccgctaaggctaaagttaccccgccgggtgtcaccttctttgctgctttccggctggttggtatagagcgacagcgagccgtgccagtcgttagtcggacgtttggtgatgatattcaccaccccgccagcggcaccggagccatagcgcgcgacggcgggcccacggatcacttcaatacgttctaccatctccggcggtacccagttcgtatcgccacgggtgtcgcgttctccgcgccagctatagcgaaccgaatttcgcgacgtcaccggcacgccgtcaatcagcactaaggtattttccggccccataccacgaatatcaatttgtcggttatttccgcgcgtccccgaggcgctattgccggtaagattaaccccaggcatcttacgaataatatcggcaagatcgttaacgggaggattcttttgaatatcgtcacgagtaataatcgaaacgcccggctgttgctttaatacttgctcggcggtggattcaaccaccatcgtttcgccgttgtcgtcagtagattctgctgctgataatggactattaacccctgtagaaaccacggttattaaccagatgaacttcttaactctcatacccattccctaaataatgtctaaagtagcgctgttgccctcaagctcacatccttgccaggttacgtctatatagtaattattatcatatgctaatgataataattatcattcaattaaggaaaaggcaatctttcgaccacaaaaatctggtaataaaaaaacggaaacgggattttgcaatatgactctctgtccgggctccgctttgccagtaaatccgggaaggggggcagaatgcgcctactgaacggaggttttacaaaacagaaatagataaaataaaactatttttcagatcgttaatcacaagaaacacccaggtaagatggtatagcacggttcagggttcaccgccgcttccctgccgacggcgaaccattcttacagtttgccagcgactttccgtctgggtaatggcgggatcggatacgattgtagccattcgatatttgatgatgaaagtgatgttggcaccaacatacaaagcgcctggtaatatttatcaggcgctttgcagacagaaaaccatcaaacatcagtttctcgttctccaggaactactggaaaatatggcaacccacagttattgggttttactgtcgggtcttgccagggattttgtgttacccccaggtcttttaaaagaccgcgtaacagcactaaatccctgggtgtcattttttgctttggttcaccctctttaggtggacgaatatcctcctgactagtacatgtaacacaataaccttttaactctatccacttaggcttagggggggccttaggatcgggaggcgtcgagctgacaacgcacgaacaggcacttatacatccaggcatagcgttttccttttcaaacaattcgctttagttggaagttctacttgagaaaataggaatggttattcagatatttttaccgtcgcatactcctgtaataataaaagatactgtaaataatttactctcagctactattcagtagcagattgttattcttacattgcttttatttcagatttacgtcaaaaagggctaaatattttcactataaaattcgttaaagagtgtttgtgtgcttgtagacattgtggcgtcttcagtacgcaaatcggttagtgtacaatctttaaaacaggtattgtttaaattagcctcagccaaatcagccccgtccaggttcgtagaaatgaaactcgcctttcgcaggtttgcccgggttaagacagcgccttccataattgcagccattatagtagcaccctgtaatgtcgcaccgctcatatcagcacgtataagggttgcgcctgaaagattagtgtgatccatatttgcaccggagcaattacattctatcatgctacagcctaacagactcgcgtgttgtaaattggcgccagtaagattagcgtgatcgagggtagcgccacacataatgctatcttccagacaggcgttcttgaaattactgtcgcctagtgatgttcccgatagatttgcgcccttaaaatttgcaccttcacaatccgccataaacagcactgccccctctaaatttgcgccgcttaagtctgcgtcacataaattttctgacgtcagatttgctccggtaaggacagcgcctttaagattcatgcctccctgggcagttaatattacagaatcctgagggagagaaaattcgcatctgaatagtaaagctcggcatattttttcaaaagaggcaagcggaatttctcttgtctcagaatggtcgcctttactgactcgtacaataacttgtccagcttcgttattctcaccaggaagattaaattcgacacgacacccatccatatcatccaggatgatgttttctggcaacggagcacctctgtcaggcattgtacttttcaatgtctcagccatagtctctatcaattcctgatattgtgtttcatttctccgacgtatcccaccacaggtaaaaaagttaatgatatattccagaatggttttgggcgaggtagcttgccgcatagcagcagaagtccccgcgccaaaagcagatttagccataccagccagactatcgagtgaacgctccatatattttctcccagagacagcaacacagtgcatgataaaatttatcatatagatttgcatttagagataaggtgaataccccctttacgtctggttacataataacgtatcacgacgcgttgctgtctggcttacacaatagcagccaaataaatatattggcttatactcgtcatacttcaagttgcatgtgctgcggccgcgttccctcaccccagtcacttactttagtaagctcctggggattcgctcgcttgccgccttcctgcaactcgaattatttagagtatataacatcatttaaaataataaacacggcattcgttttaatactacgttctggactcatcccactcattagcagaaaacctattaaaaagcgtgttcaggcattttattaccgccattgataaactgtttaacaacatcgtctgtacagaccttcttcgttgcctttacgtttaactcaatcaggctaccgtctcggttataagtctatcgagtagtagagccgtagtatgacgatgcagcaaagtgatatggaaagatataatccattattaatgttaaaagaagtcatggcgcagacgccttatcgccataaacgctggggagagcgtaagtttcgttataaatttttattacgttgccttattaaccccgtaacgacaattaaatacttcaatgaattatgccatctgtctcagcccagaacgctgattattcatcgtccactgttgccggcaaaaatccagcggccctatttgtataccgggcttagcatacgttgccgggcaaaagctattctggaacactaccagttcgttcagtcctttccggaaagtaaaattaaaaagatcctcctgtccgaggaacaaatcttactcgctcacctggaaggaaaaaacggtgctctggtagatatctactgcggtccctgtggctatgacagagaaggtgaactgacattaacgctgtgcttcaatgatacgccgttggcacgtttatcattttcctttatccgccatgaagggaagcaaatagcgctggttgccgggttacaagggcccagtaaacatatcggcccacaagtcatacgtaacgccaccaaagattgttacggtctctttcctaaacggatgctgtatgaagcatttgcgacattgatgcaggcctgtaatgtcgacgagatttatgcggtcagtgaaaacaaccatgtttatcgtcaactccggtacttattccagaagaaaaaaacttttgtggccagctatagtgaattctgggagtcgctaaacggcgttaagaaaggtgccttatatcatctgccatcacaggtgatgcgtaaagcgcctgaaagtatccccagcaaaaaacgcgcagagtatcggaaacgctatcatattctggatacaataatacaagaggtcaacagcctctcccggtagaactatttcatacgcggatgtgcagatcctgctaccgttcagcggatcttttgaaatctgtatcgctactggatggttaaatacagaatggcttgcgagtgaatagcgcggcattaaaccgtcgctttcactcatgttatgatcaacatcttaatcttattcccttcaccataacgtcatcgattagcatgttaaccattaaatacaagctaaacatttgtcacatttttatttggttaagcaaaaaaataatacaaaatagcattttcagtaagctaagtcaggagttttggtgaaaatacaagaagttaagcgtatattaacccgctggcaaccgtcttccttttccctataccgggaggtgtttacgcaatacggcggtagtatcaatatgcacccagatattgtggattatttcatgaagcgctataactggcattttaaattcttccactataaagaagatgataagattaaaggcgcctactttatctgtaatgatcagaatattggtatcctgacgcgcagaaccttcccgctatcttcagatgagatacttattccgatggcgccagatttacgctgcttcttgcccgatcgtactaaccgactttcggcgttgcatcagccacaaatacgcaatgccatatggaaactcgccagaaagaaacaaaattgtctggtcaaagaaacgttctcttctaagtttgaaaaaacacgccgtaatgaatatcagcggtttcttaaaaaaggcggaagtgtaaaaagcgttgctgattgttcttctgatgaactgactcatatttttatcgagttatttcggtctcgtttcggcaatacttcatcctgctatcccgctgataaccttgccaacttttttagtcaactgcatcaccttctgtttgggcatattctttatattgaagggataccctgtgcatttgatattgtactgaaatctgaaagccagatgaacatctactttgacgtatctaatggtgcaattaaaaatgagtgcaggccactcagtcccggcagcatactaatgtggctaaatattagccgtgccagacattactgccaggaaagacaaaaaaaattgcttttttccatcggcatactaaagcctgaatgggaatataagcgcatgtggtcgaccccctattttaccggaaaatcgatttgctaaaaagaaagcctggacgtaaatatgttttttacgtccagatttttcataaatcctgatgaactgataaaaaacgaaaatttaatcagaatttaaaaaataagttaaccaccatataatcataatgacaattactcgaaattcacttacactatactcggttttatggaattgattaacacggtatgttacagataacgtgctaaaaagcgtgcagcggttatacattttcatatgtgtgtgtcattaacctggcgtcaggaacagatgatgatgacaactacccttttatctcttctggcctggcataccgtcagtagattaaaggagtagccttgctttatggcattacaaaaatgcgggtggggtctatgctcaatgtatacgttatttgtaacaacgctcttgtgcataaacaatacgttattgccaacagcactgaacgggtacagtggttcttgctgacaacaggcttaaagatcgccttaacacgggatacctgataactggattatattatgacacatgcagactggctgattcttgggtatacaactgttattattatttttggtattgtatgttatatcggattgcttaaattgataacgaaaggcaagcatgaaaaataacgcacttaccgggaagaatatactctcaggagataaaatgcttcggcaatgatatgacaccactgccgaaatgctatttttaaagaaatcaatcaggtattgagggtgattttatcatagccgcgccagcgataattcaacaccgagagcagccagaatagcacaaaagcacccactacccagaagcccacattccccatatgatcgttaagcgtgctgacggtctgccaaaatgttccgcttaactgtaacgcatcatcaatcaaccccagcgcctcaagcccgccaatcgccagcgcgacaatgacggatgcggcggtaatggtcatattataataaagcttacgtaatggatgcgagaaagcccaaccgtaagcgccgaccatgacaaagttatccagggaatctaccagcgccatcccggcggtaaacagcacaggaaaaatcatcattgaccagagagatagcccctggttagctgctgaagcggaaatgcccagcaacccaacctcggttgcggtatcaaatcccagaccaaacagaaaaccgacaaaatacatatgccaactggaagtgaccaaacgaaacgtacgctgaaatatacgcgtcatcagcccgccaggtatcgcctcgtcatgcgccctcactgactcgccgcgggtaaccgagcgaaattgccgccagacgttgaacaaaataaacaggttaagcagggccatcgccagcagaaaaaaagcggaaacagccgtaccaatcaacgaaccatattgatgcaaaacatcaatacgatcgcgaaatgccatcgacgtcacaacaatcgccagacatgccagaacgacaatggtcgaatgacccaatgaaaaaaacgcccccacgcctaaaggcgttttaccctgctgcatcagtttacgggtgacggtatcgatggctgcgatatgatcggcatcaaccgcatgacgcagcccaaagctatacgccagtatggctgcgcttagcatgacggcatggtgatgaaaaacacagaacgcccaaatccaggccaggatgttaaccccgacaagaaagacggttaatgctattccccgtcgtttagtatgattattcatgcccctgcacccactatatttttaattaacgctacggtttgtagggggaatgtatgatcatttgattaaaacgtcacacctcaagatgcgactttttgtaaacgtgctttaccgctgacacatttgtccgcattactgcggaacaaggcttaaaaagcgtatccgaacgtataaccctcccaacgcttcgctacgggaaaaatggggatgagtacggtgcaggcgtgcgatatcattgaccaaagccagaccaatgcccgccccggccacatttcctacgttatcgagccggtggaacggctgtagcgccagatggatgtgttcatcatcgatgccgggaccgctatcttcgacaaccagcgtcacggcatcgccatcccgttcaagccgcgcggtgacgatgccttgctcaggcgtgtatttcagcgcattatccagcaagtttccgcatagctcgctaagcagtacctcatccccctcgatccacatcgcttcctgttcgccttcgtagcccaggtcgatatgtttactgcgcgcctgcgccagacgggtaaaacagccgctctgtacgatatcgtacagattcaccggggaaaaacgccgctcgccctgctctttatgctttaccgcagaaagttgcaacaatctttccgtgagctgaatggtgctatccagcgttacgctcatcgcctgcagactttcgtaccagtgatgagggtgctggctggctaacgccaccgccgcctgcgtttttaacaccgccagcggcgtttttaactggtgagaagcatcggcgctaaagcgttcctgccgggagaggatgccgcggagcctgtcaatgtagcgattaaacgccacgattaacaagcgtgtttccgaccacggcagcagttccggcagcggcgttaacagacccggttcgcggcgtaccattaatgacgaaagttgacgcatagggcgcaggatccggcgtaataaccagccaaccagcaccagggtcagcaacaccagcagaccctgtgagatccaggaagagaacagcagttggcccgccagataacgacgggactgcagcgtctctgcgacataaatctccgccatgccgataatgccgccttcgttgaccggctgtagcaaacgcgccacgcggatcgcctcgccgcgatactcggtatgatagaaccacgccagcgccggataaagccgggtacggggcgtagcgggcggcatgacgggcagatcgtcataaccggaaatgacctttccggaagggtcgacgactttgtaatagagtcgatcattcatattaagctcgaagctatccagcaccacccagggcacgttaacttccagatggttattgcgcaccaccagccgttccgataccgttcgcgccgaggagagcaacgtacgatcataagcctgagtggcggcctgtagcgcattgacataactgttaaacgccgacagcccccatagcagaatcagcggcaaccccaggaacagtaagagttgcaggtacaacgattgcggcttaacccacttcatcgccgcgctccagcacataacccaggccgcgcagcgtcgtaattcgtacatcgcttccctgaagttttttacgcagtcgatgaatataaagttcaatgctttcagggcttacctcatcgttcaggctgaacacctgttcaaaaagctgctgacgcgaaactggtcgcgttcgtcggtacatcaatacggttaagagcgcctgctcacgcggcgtcagcgctaacggctgcccctgtaacagaaaatacccttcatcatgaaagatcaattcccccagttgctgaacttcatgaacctgcccagcgctgcgtcggagcaaggcccgtaaacgggcatccagctcttccagttcaaagggtttcggcagatagtcatccgcgccgacgttgagaccttttacgcgatccgccaccgcgcttcgcgccgtgagcagcaaaacgggcaaggtctgaccgcgtttacgcagccgttgcaccacctccagtccatccattcccggcatattgatatccagcaccgccagcgcgtacatttcactgtgcagaagatggtcagccgccaggccgtcaaatacgcagtccacggcaaagccgttttgcaccagcgctttctccagccagtgagccagctcacggttatcttctgccaataagagacgcatatcacatcctgtaaagtttctgccgcattgaaagggaattgaaaggttattgttttaacaatcacgcaaccgaactgctacatgtcggctcacataatcacaaaaatcttcttccgaacctgaaaaatccggacgtccggcgtgaggataaaaaatgaaaaaacaattacttcgtacccttactgcaagcattttattaatgagtacctctgttctggcgcaggaggcgccgtcgcgaacggaatgtatcgcgccagccaaacctggcggcggtttcgacctcacctgtaagctgattcaggtgagtttgctggagactggcgctatcgagaaacccatgcgggtaacgtatatgcccggcggcgtcggcgctgtggcctataacgcgatagtcgcccaacgccctggcgaacccgggactgtggtcgccttttccggcggttcgctgctcaacctgtcgcaggggaaatttggtcgctacggcgtggatgatgtgcgctggctggcaagcgtgggcactgattacggcatgatcgccgtgcgtgcggattctccgtggaaaacgctgaaagatctgatgacggcgatggaaaaagatcccaacagcgtggtcattggcgctggcgcctctattggcagccaggactggatgaagtcggcattgctggcgcaaaaggcgaacgtcgacccgcacaagatgcgctacgttgcctttgagggcggcggcgagccggtgacggcattaatgggcaaccatgttcaggttgtctccggcgatctcagtgaaatggtgccttatctgggcggcgacaaaatccgcgtgcttgccgtcttttcagaaaatcgtctgccgggccagcttgccaatatccctaccgctaaagaacagggctacgacctggtgtggccgattattcgcggcttctacgtcgggcccaaagtcagcgatgccgattaccagtggtgggtggataccttcaagaagctccagcaaaccgacgagtttaaaaagcagcgcgatctgcgcggcctgtttgagttcgacatgaccggccagcagctcgatgactacgtgaaaaaacaggttactgattaccgtgaacaggcgaaagccttcggactcgcgaaataatcgcggaggcaatgatgagcgatcgtatctttgcgggtatctggctgttgctctgtatcgccgggctattcatcgcctggcagatccaaagcgaatacagctatgaacccgtcggcccccgcccttttccgctggggattatcggcctgatggcgctctgcgcgctggcgctgttattgcgccatcccgacacggtgagctggccgcgccgccatgttctgcaaaagctaattaccatgatcatcatcctgttgatgtatgcctggggattcgaatggctgggttttcccatcgccaccgcgcttctcaccatggttatcgggatgctgttcggcgccacgattccggcggcgggtatctccggcgcggtattgggcattctgctgtggtatgcctttgaccggctgcttgatgtcaccttacctctcggcgcctggctgagttaacggagcaacgatggatacctggatatatctttctcagggctttgcggtggcgatgacgccggaaaacctggttatcgcgttgattggctgcttcgtgggcacgatcgtcggtctgctgccgggtctgggaccgatcaacggcgtggcaatcttactgccgctggcctttgcgttgcatctgcctgcggagtcggcgctaattctgctggcgacggtgtacattggctgtgagtatggcggcaggatctcctccatattgctcaacgtccccggcgatgcggcggcgatcatgacggcgctggacggttacccgatggcgcagcaagggaaaggcggcgtagcgctgtcgatttccgcagtcagctcatttttcggttcattaatcgctatcggcggcatcattctgttcgcccctttactggcgcaatggtcgctggcctttgggccggcggaatatttcgccttaatggtttttgccatcgcctgtcttggcagcatgatggcgcaaaacccgcttaaatcatttctggcagcgctgatcggtcttggccttgcgaccgtcggcgtggacgccaacaccggggtttatcgctttacctttgacagcgttcatctttccgacggcgtacagtttatcgtcgtggtgatcggcctgttctcggtatcagaaatacttttaatgctggaacataccagcagcgggcaaacaatggtccgcaaaacgggtcgaatgttgttcaacctgaaagaaggcgcgcagtgtatcggcaccaccctgcgttcttcggtaatcggcttttttgtcggcgtattgcccggcgccggggcgaccattgccagcgccattacctatatgaccgagaaaaaactcagcggcaacagcgatagcttcggcaaaggggatattcgcggcgtcgcggcgccggaggcggcaaacaacgcctctgcctgcggctccttcatcccgatgctgacgctgggcgttcccggttccggcactacggcagtgatgatgggggcgctgacgctgtacaacatcacgccaggcccggcgatgttcaccgaacagccggatatcgtctggggactcatcgctgcgctgctgattgcgaacgtgatgctgctgatcatgaatatcccgttgatcggtctgttcacccgtatgctcaccattccgctgtggttcctggtacccgccatcgctgccgtatcggcggtaggggtgtatgcggtacacagcaccaccttcgatctggtgctgatggtcgcgctcggcgtgttagggtacattttacgtaaaatgcacttccccatgtcaccgctgatcctggggttcgtactgggggaaatgctggagcagaacctgcgtcgcgcactctccatcagtaacggcaatatggcgattttgtggcaaagcggcgttgccaaagccctgctgatcatggcgatcatggtcattgtcgtaccgccagtgttacgtctgctccgtaaacacagccgtaaaccgcaggttgacgccggttaattgactgctgaaatacgttgtacttgtccggcctacgcgctcatgtgtcaggccgggcaaccccgccagcatcactttccccataacgctctcattttacaccccttcttgccgttgtcaggctcgtggcgccgttaacctcaccctttgcattgttaaatatttgttgtttttgatcacaataattaaacaaaagcggttatttcatacgcgttcctggaaaatgtcgatatttttaatttatggctacgaaatgagcatcgccatgtctccctgaccatctaccgagaggaatgattctgatgaatgcactgactgccgtaaaagcgaacacagatgatttagcccaacgccatactggtttcacccttgccccttcggcgcagtcgccgcgcctgctggcgttaacgtttacggcggataccacaaaacaatttcttcatcaggttgcgcagtggccggtgcaggcgctggaatacaaatctttcttacgttttaaaatcggcaagatcctcgacgatctgtgcggcaatcagctacaaccgctgttgatcaaaacgctcctcaaccgtgcacaaggcgcgctgttgatcagcgccgaagggatcgatgatgtcgcacaggcagaagagatggtcaaactggcgacggcggtggcgcatcttattggtcgctccaactacgatgcgatgagcggccagtactacgcgcgtttcgtggtcaaaaacgtcgacaactccgacagttatctgcgccagccccaccgcgtaatggaactgcacaatgacggtacctatgttgaggaggtgaccgactacgtgctgatgatgaaaatcgacgaacagaatatggaaggcggtaattcgctgttgctgcaccttgatgactgggaacatctggagtcgttttttacccatccgctggcgcgtcgcgtcatgcgctgggcggcgccgccaagcaaaaatgttagccatgacgtctggcacccggtgtttgatgtcgaccaacaaggccgcccggtcatgcgttatatcgaccagttcgtccagccaaaagactttgaagaaggcgtctggctcagcgagctttcagacgcgctggaaaccagtcaaaacatcctctccgtaccggtaccggtcggcaaattcctgttgattaacaatctgttctggctacatggacgcgatcgttttacgccgcatcctgacttgcgtcgcgaactgatgcgccagcgcggttacttcgcctacgccgccagccattatcaaactcaccaataagcgccacggcgaaggaattacgcggatgtatgattttgtgattatcggcggcggcattatcggcatgtcgaccgccatgcaacttattgatgtctacccggatgcgcgcatcgcgttgctggaaaaagagtccgcgccagcctgccaccagaccgggcataacagcggcgtgatccatgccggggtgtactacacgcccggcagcctcaaagcgcagttttgtctggcaggcaatcaggcgaccaaaaccttttgcgatcaaaacaacatccgctacgacacctgcggcaaaatgttggtcgccacctcggagctggaaatggcgcggatgcgcgcgctatgggagcggacggcggccaacggcttagagcgcgagtggttaagcgcggcggagctgcgtgaacgcgaacccaatatcattggcctgggcgggatttttgtcccttccagcgggattgtcagctatcgcgatgtcgcgacggccatggcgaaccgctttcaggccaaaggcggcgagatcatctaccatgccgaggtcagcgcgctaacagaacatgccgctggcgttgtcattcgcacctcgcaaggtcgggaaatagaaaccgctacgcttatcggctgtgcaggactgatggcggatcggctggtcaaaatgctgggcgtggagcccggttttattatctgccctttccgcggcgagtactttcgtctggccccgcgacacaaccggatcgttaaccatttgatctacccgatccccgatccggcaatgccgtttctcggcgtccatcttacccgcatgatcgacggcagcgttacggtcgggccgaatgcggtgctggcgcttaaacgcgaaggctaccgtaagcgcgacgtttccttcaccgacaccctggagattttccgctccgccggcattcgccgcgtactgcaaaaccatctgctttccggactgggcgagatgaaaaactcgctgtgcaaaagcggctatttgcggcgagtacaaaagtattgccccagcctgaccgtcaacgatctccagccctggccggcaggcgtgcgggcgcaggcggtttcaccggacggcaaactgattgatgattttctgtttgtcacaacgccgcgttccattcacacctgtaacgccccctccccggcggcgacatccgcgatacctatcggcgcgcatatcgtcagcaaagttcaggcgctacgcgcaagccagagcaaccccggacgtacgctgcgtgcggcacgcagcgtggacgcattacacgccgcatttacccgttaacccttcagacaggaagcaattatgcaacttaacgactctaccctgttccgccagcaggcctttatcgatggcgactggcgcgacgcgcgcggcggcgatgtcatccccgtgagcaaccccgccaacgggaaaccgcttggcaatgtgcccaaaatgggggcggaagagacgcgcgacgccatcaacgccgccaatcgcgccctgcccgcctggcgcgcgctcaccgccaaagagcgagccaatatcctgcgtcgctggttcaatctgatgatggaacatcaggacgatttggcgcgtctgatgacgctggaacagggtaaaccgctggcggaagcgaaaggcgaaattagctacgccgcctcgtttattgaatggttcgccgaagaggggaagcgtatctatggcgacacgattccaggccatcaggccgataaacggctgctggtgattaaacagcccatcggcgtcaccgccgcgattaccccgtggaactttccctcggcaatgatcacccgtaaagccggccccgcgctggccgcaggctgcacaatggtactcaaacccgccagccagacgccgttttccgcgctggcgctggcggaactggcccagcgcgccggaattcccgcaggcgtatttaacgtcgttaccggttcggcaggcgatatcggcggcgagctgaccagcaacccgctggtacgcaaactgtcgtttaccggctcgacggagattggccgccagctaatggaacaatgcgccaaagacattaaaaaagtgtcactggaattgggcggcaatgcgccgtttatcgtctttgacgatgccgatctggataaagccgtcgaaggcgcgctggcttcgaagtttcgcaacgccgggcagacctgtgtctgcgccaatagattgtatgttcaggacggcgtttacgatcgttttgcggaaaaactcaaccaggcggtaaataagctcgcggtcggtgacggcctgcaagccgacgtcgctatcgggccgctgattgatgaaaaagccgtggcgaaagtccaggaacatatcgccgatgcgctggaaaaaggcgcccgcgtcattacgggcggtgaagcgcacaaattgggcggcaacttctttcaaccgaccattctggcggatgttcctgataacgcgaaagtcgccaaagaagagacattcgggccgctcgcgcctctgttccgcttcagcgacgaggcggacgtcatcaggcaggctaacgataccgagttcggcctggcagcctatttttatgcacgcgatttaagccgcgttttccgcgtcggcgaagcgctggaatacggcatcgtcggtattaataccggcattatctccaacgaagtcgcgcctttcggcggcattaaggcctccggattaggccgagaaggttccaaatacggcatcgaagattatttagaaatcaaatatatgtgcatcggcctttaacaggagagtcgctaatgaataccaataacgctttaatgcagcgccgtcataacgccgttcctcgcggcgtggggcagattcacccgattttcgccgagcgggcggaaaattgtcgggtgtgggatgtcgaaggccgtgagtatctcgatttcgcgggcggcattgccgtcctgaacaccggtcatttacatccgggcattgtttcagcggtcgaagcgcagttgaagaaattgtcccatacctgttttcaggtgctggcctatgaaccgtatctggcgttgtgcgaacgcatgaaccagaaggtaccgggcgatttcgccaaaaaaacgttgctggtcacgaccggttcagaagcggttgaaaacgcggtgaaaatcgcccgcgcggcgacaaaacgcagcggcgctatcgcgtttagcggcgcttaccacggtcgtacccactacacgctctctctgaccgggaaagtacacccgtactctgctggtatgggattgatgccaggccatgtctaccgcgcgctttatccttgcccgctacacaacatcagcgacgacgacgcgatcgccagcattgaacgcatctttaaaaatgatgccgcgccggaagatatcgccgccattattattgagccggtacagggcgaaggcggattttacgccgcctctcccgcgtttatgcagcgactgcgcgcgctatgcgaccaacacggcattatgttgattgccgacgaagtgcaaagcggcgcgggccggaccggtacgctgttcgccatggaacagatgggcgttgcggcagatattaccacgtttgcgaaatcgatcgccggcggctttccgctggcaggcgttaccggccgggcagacgtgatggacgctatcgcgccgggcgggctgggcggcacctatgccggaaacccgattgcctgcgccgccgcgctggcggtactggacattttcgagcaggaaaatctactgcaaaaggcgaatacgcttggcaaaacgctgcgcgatggcctgatggagatagcggaaacgcaccgtgagattggcgacgtgcgcggactgggcgccatgatcgccattgagttgttcgaaaatggcgaccccggcaaaccgaacgcggctctgaccgccgacattgtgacccgcgcccgcgagaaagggttaattctgctctcctgcggtccttactacaacatcttgcgcatcctcgttccactcactattgaggcctcgcagattcggcaaggcctggagattatcgcccagtgctttgatgaggcgaaacaagcgtaatgtccaataagcagcgtcgggtggcgacgtaactgtcttatccggcctacaaaaaccgtttcgattgtaggccgaataagccaggcgccatccggtaaacgagcgcaataacaataaagaggttttaggatggggcaattgtcagaatcacatgcattagggggcgggctgaaatcacgccacgtcaccatgttatcgatcgccggcgtcatcggcgccagcctgtttgtcggttccagcgtggcgattgcggaggccggccctgcggtactgctggcctatctgttcgcaggacttttagtcgtcatgattatgcgaatgctggctgaaatggccgtcgccacaccggataccggatctttttccacctatgcggataaagcgatcggcccctgggccgggtataccatcggctggttatactggtggttttgggtgctggttattccgctggaggccaatattgccgccattattctgaattcatggataccgggtattccggtatggctattttcattagtgattacgcttgccttaaccggaagcaatttattgagcgtcaaaaattacggcgagttcgaattctggctggcgctatgtaaagtaattgccattctggcgtttatcgcgctgggcgcgacggcgattagcggtttttatccgtatgctgaggtaagcggtatctcccggctctgggatcacggcggttttatgcctaacggcttcggcgcggtgttaagcgccatgttgatcaccatgttctcttttatgggcgcggaaatcgttactattgctgccgcggaatccgatacgccggataaacatatcgtacgcgccaccaattctgttatctggcgaatttccatcttttacctgtgttccatttttgtggtggtggcgctgatcccgtggaatatgccgggtctgaaaagcgtaggttcgtaccgttcggtactggagctgcttcatattccgcacgcaaaattcattatggactgcgtgattttattgtcggtgaccagttgtctgaactccgcattatataccgcctcccggatgctctattcccttagccgccgcggcgatgctcctgcgataatgggaaaaactaaccgtagcaaaacgccctgggtagcggttctcctctctaccggcgcggcctttttaaccgttatcgtcaattattacgccccggcaaaagtgtttaaatttcttatcgacagttccggcgccatcgcgctgctggtctatctggtgattgcgatttcgcaattgcgaatgcgtaaaattctgctggcgcagggcggagaaattaagctgaaaatgtggctttatccgtggctcacctggctggttatcggctttatctgctttgtcctggtggtgatgctatttcgaccggcacagcaactagaagtcatttcaacggggctgttagggctgggcataataggtactgtccccattatgtctcgctggaaaaaactgataaggtggcaaaaagcccccctgcaaaacctacgttagttattcccggcgtcagccgggaagcttctcaggagtaaaagatgaccgccctttcccaaccgacggccatagatggctatcgctggcttaaaaatgacattattcgcggcacttatcagccggatgagaaactgcggatgagtttattaaccgcccgctatgcgctcggcgtagggccgctgcgtgaggcgctgtcgcaactggtggcggaacggctggtcaccgtggtgaatcaaaaaggctatcgcgtggcatccatgtcagaggcggaactcctcgatatttttgacgcgcgcgccaatatggaagcgatgctggtacgcctggcgattgaacgcggcgatgatgcgtgggaggcggagatcctggcgcgagcgcatatgctcagcaaactggaagccagcgatgccagtgaacatatgctcgatgaatgggatcagcgccaccaggcgttccattccgccattgtcgccgggtgcggctcccactatctgctacagatgcgcgaacgcttatttgacctggcggcccgctaccgctttatttggttacgtgaaaccgttctgtccgtcgagatgctggaagataaacatatccagcatcacacgctaaccgaagcgatactggcgcgcgaggcggcacgcgccagcgaattaatgcgtcagcatttgctgacgccgattcccattattcgccaggcgatggcagggaaaatgtagcctggcgcgacctgatagccattattcttcaggaatacgcaacacttgtcccggatatattttttccgggcttttcagcatcggtttatttgcctcgaaaattttattatacagattggcgttaccatacacttgctttgaaatagcgctcagggtgtcgcctgattttacggtataaaactgactttcagccgccggcgtcgtggttttaacctgatcgtcaacgctgctaatcccggcgatattccccacggcaaccagaattttttcttttgcctcctgactcagcccatcacccgtcactgtcgcttttccatcagctatttgcacattcactttgtcagcgtcgggtattcccgttttatttaaatgttcctggacttttttcgcctgatcgtccttatcatgattagcggttaccgcgtcccagagtttttcacctgcatcttttacaaaattgaaaagtcccatattcacctcgcttgtcaaaaatacacacaaagaaaagtgtagcagagggaatgaggttatcctgataagcggcgcttatgcgccgccggtggccggtaattaatgacgcatctgaacccaaaatgcgtggataagccccggaatatatccgagtaatgtcagcaggatattaaggataaatgcccaaccgaacccttttcctaaaagtacgccgagcggaggcaaaataatcgtaaatacaattctccagaaacccatatacactccatacaagcaaaattagtcattgtttaaaaagagattttatctctaagcatagtcagtttacctgagcctgccagtcgcgcgccgcgcttttaccctcctttacgctctttacgctggcattaggttgatgtttattttagaattaactaaatttagaaaatacttaaataactatgacagagcttgaacaacttcaggccagcgcagaacaggcggcggccctgctcaaagcgatgagccacccaaaaagattactgattttatgtatgctttgcggttcgccaaaaaccagcgcaggcgaactggcgcgcattaccgggctaagcccctccgcgacgtcgcaacatctggcgcggatgcgggaagaagggctgattgatagtcaacgcgatgcccagcgcattcactatttcattaaaaatgaggcggttaatacgattatcgccacgttaaagaatctctattgtccataaggaggcacgatgtccattgggatagtttccccccgtgaggcgcaagcgctgatagcgcaaggcgcgaaactgattgatgtgcgcgacgccgatgaatatctgcgcgagcatattccacatgcgcaactggcgccgctctcccggcttgaacagggcgatttgcccgccaacctgcgagcggaacagattatttttcactgtcagtcaggtaaacgaaccagcagcaatgcagcaaaactacaggccattgccgcccctgctcaggtcagtctactggaaggcggtatcgacggatggaaagcggcaggattgcccgtcacagaagacaaatcgcaaccgttgccgctgatgcgtcaggtgcaaatcgccgccggcgggttggcgttgcttggggttattatgggctatacggtccacggcggctttttcctcattagcggttttgtcggggccgggttaatgctggcaggcatgaccggcttctgcggaatggcgcgactactggaaaaaatgccctggaatacccgtactcattaagcggtaccttcaccacgcgtcggtaagtgtgtagtagactgaaggcgggtttataccattgttcaacaggagggcgtgatgttcacaccaggcgatatcgtacagccccgaatgggtgggccgaaactgaaagtgattgaagtcaacgaggatcatattgtcgcggtacaggtcggtaatgaaccgggcgaaaaattgatcctcaaagcggcagatgtcaccccctattgcgaagagggcgattttggcgtgtgctgatttatcaaaatgagcatggcgcaacgttccctgagtcccggttaatagagacaggaaacgaagcgccatctgttaaaagctatccgtgattagattaagaaatcatccagagatttccccgccgccagcgcctgggcaatcggtttaggcgtacgaccttgtccggtccaggttttttcttcgccattgaaatcagtaaaacgatattttgccggacgcggctggcgctttttagcagaacgcggcattgctgaatccatggcaaataactcttccgggttaataccgtctgctttcatcagctccagaaaggcattaattttctcctgcttctcggcaagctggcgttgctgcaattcttcttcttcgcgtctttctttagtgacaaccctgaatttttcgagcatttcttcaagaacgtcaatggagaattcgcgagccatagcgcgcagcgtgcggatattatttaagttctgtaacatcaaattcatatcaataaaaaccttttaacgcagaaaacaaaaaactattacaggcggtattgtatgcgattgttgattatatttccagatcctaaagttcatacagatatacacagcataactcgattaattatattaatctgttaaccagaaggttatattcattaccccctgcgtgtttcaggttattctgcctacggtatatctgtaggtttcccgtttggctgtttatagcgtattgcgtatctcagtaaccgcggtgaccctcacggtggctgaccttatacagaagtgaatatttcagcacaataagagattaaccattcaaaaatcatcatcagagctttatgctaaaaatcagtctgcaatggctataattatgctgagaaaagtagagcgcatgccgttagccgagaatacatcgcatctgacaacatttggaatgtggctgaaaatcgccagaaaaacaatgcattataatgcattgatttaaaagtaattaatgactaacaacaacgaaaatctcgccgcgagcaaaaaacacacaatcacagagtattttatcgacaaaaagcctataaataaaaatattacactagttgatagttattatatagggatatactctatgcaaagacaaaagtgctttatgatttcactaccaaccatcacctcattctgatcgatacgctacaaggagcattaacatgttctctccacagtcacgcttgcgtcatgccgtagcagacacgtttgcgatggttgtttactgttctgttgtgaacatgttgatcgagatattcctctccggaatgagctttgagcagtcgctttcttccaggctggtggcgatacctgtcaacattttgattgcatggccatacggcgtttaccgcgatctgattatgcgcgtcgcgcgtaaggcaagcccggcgggatgggccaaaaacctggcggatgtattggcttatgtcacctttcagtcacccgtttatattatcatcttgctgaccgtcggtgccggctggcatcagatagtggccgccgtgagttcaaacattgttgtttcaatgttaatgggcgcggtttatggctacttcctggattattgtcgccgcctgtttaaagtgagcagctatcatcaggctaaggcgtaagttagcgtcgcgactggcattgccagtcgcgcttttagtcggttttttcgtcgccaaaaagcccattcagataacgttctaacgctattcgggagctaaagccgtggggaataccgtaatgttcgtgggtctcgccgcctaaatagagcggaaagttttggtaatgatcgcaggttttaatatccgaagccgggtcagccagtgatgagctacggtcttttaatctggggtgaatgatcagcgcggtacgccccatacgcgcctcgcggttaacataaacataattctcgccgcgtcgataaccatacgtcttattcgtcaccacatcgacggtaaaccctgccttttccagtacccgcgccacctcgtcaggtcgtaaatacatattttatcctcattctcttgtactgcgggcttaccttacccgatagcgcgttatcaacgctttcagaaaagtccagaaacgcatgatatcgccgtaacaagcctcagcaggtaaaaatatgaactacactgaaagctacatcgaaatcaatggaggatcatatgcttaacaaaccgaaccgaaacgacgtcgatgatggtgttcaggatattcagaatgatgtcaatcgattagccgacagtctggaagatgtccttaaatcctggggaagcgatgcgaaagacgaagccgaggctgcgcgacgtaaagcacaggcgttgctgaaagagacccgggcgcggatgcagggtcgtactcgcgtaaaacaagccgcctgtgatgcgatggggtgcgcggatacgtttgtgcgtgaaaaaccctggtgtagcgtaggaaccgccgcagcggtggggatttttatcggggcgctgcttagcctgcgtcgctaacgacgtgcgctgccggatggcgacatactttatggggcctgcatcattgccgcaggcccaggtcgcgccattcggcgaaacggttactgtatcgcctgtcgaagctgacatgcgacctgtttcgccatgccagcggaagtaatattggtaaacgacagtaaaatgcccccctttcctgacgaaaccactcgccaacggcttagcgcctgtaccgccagtccggcctgattcgcttttgctacctgcgctttatcatcaccttcaacctcaataaccaattgaataccgcctttctgtaatgtcacgacaaatccctgttctgccagcgcctcttcaatccataaccgtcgctgagcataatgttgacgcatctttttcagatgccgccagaaatggccatcacggataaaatcagccagcgtgtgctgccataacaacggtacgctacagggcatcagcgacgcctgctggcggaaatgctcaatctgctttatcggcaccaccagccaggcggtacgtaatgccggaaagagcgacttactgaacgttccggcgtaaatcactcgctgcggggcatccagactcttgagcggcggaagtggtttaccgtgataacgaaattcgctgtcgtaatcatcttcaataatccaggcctgcacattcgccgcccatgccagaagttgccgtcggcgagttaacgacagcgccacccccaacggactttggtgggcgggcgtcaccaatgcaaagcgcccctgcgggcaatcccgcatccccgccgcgacattcagcccatcggcatcgaccggaatcggcgccagcgtaatcccctcctgcgttatcaccgggcgaattaacggaaagccgggatcttccacccacatgctgtctcccggcacagacaatgtacgcaggattagccgcatagaatccgcataaccggaggtaataaatacctgttccggcagacattcaatgctacgcgaaacccgcaggtaatcgactatcgcctggcgcaaaatcgcctcgccgcagacgtcgcctaatgccagatcgaagcatgtctgcgtgcgcaaccgacgccccattactcgcgcccacttctcgcgtggaaagagatccagcgccggtaaccccatctgaaagggtttcggttccggactttctccggcaaaaacagcgggtatcggcggcgccgtctcaaaccgtagagcgttgctcacaaacgtgcctgcctggccacgtcgctccagccagccctgcgccaccagctcgccataggcattttccaccgtggcgcgagaaacgcccagttcctgcgcccacgtcctactggaaggcaaacgcgttccgggcgcgagttctccttgctcaatggccgtttttaactgacgagcgatgtgctgatagcgcggcatatggtctgctttttctgtaaaaatatggctctcttttacagaccattatagtgctacagtgctcgtcatcaacacgaggagaaacatgatgacaacgttacgccaaccctattatgaactgagcccggaggtttacagcgctctggtgcaggcgaaaaacgcgctggaaaagagcacgcttgaccccacgctgatggagctgatttacctacgtgtttcgcaaataaatggttgtgcattttgcctggagatgcacagtaaagcgctgcgtaaggctggcgtgaatcaagctaaattagatgcgctggcaggatggcgggtaagtcaccatttcagcgagcaagagtgcgcggcgttagcctgggcggaatcggtgacgcacattgctgaaacccacgccgaagataatatttacctgccgctgctcgatcatttcagcgcgcgtgaaatcagcgatctgaccttcgccatcggtttaatgaactgctttaaccgtctggcgatcggtatgcgaatgtgacgcattgttgccggatggcgctgatgtcagccaactctgttatgcgtgaacctgcaggccggatcgggcgttcacgccgccatccggcaaaaattagccatgcctcccctaccccgcggcgttcatcagcggcgttaaaatcaatcgaaaattcccatatcttgtatggttgaatcttaattcaactacatctagtatttcctgtatcaacacacgacaatccgacgcgtttcatcgcgccgttttctcattttaaatggaaatacgaatcatgagcattactatttacactcgcaataactgtgttcagtgccacgccacaaagcgggcgatggaaagccgtggatttgaatttgagatggtgaacgtcgatctggtgccggatgcagcggatacgctccgggcgcaaggatttcgtcaattaccggtggtgatggcgggcgatttgagctggtctggcttccgcccggacatgattaaccgtctgcacccgacaccccacgcggcaaacgcatgagcgcgctcgtctacttctccagcagctctgaaaatacgcaccgctttatgcagcgtctggggctgcctgccacgcgtattccgctcaatgagcgggagcgaattcaggtagacgaaccgtacattctggttgtgccgtcatacggcggcggcgggatggccggtgcggtgccgcgacaggtgatccgctttttaaatgatgaacacaaccgggcgcgcattcgcggcgttatcgcctccggtaatcgcaatttcggcgatgcctggggatgcgctggcgatgtgatagcacaaaaatgcggcgtcccctggctgtaccgctttgagctcatgggcacacaacgcgacatcgataatgtccgaaaaggagtaaatgaattttggcaacaactaccccggagcgcgtaatgcaggaaaccatggattaccacgccctgaacgcgatgctgaatctttacgataaagcaggccatattcagttcgacaaggaccagcaggcgatcgacgccttctttgccacccacgtccgcccgcattccgtgacgtttgccagccagcatgaacgtctggggacgctggttcgggaagggtattacgatgacgccgtcctcgcgcgttacgaccgcgccttcgtccttcgcctgttcgagcacgcccatgccagcggctttcgcttccagacgtttcttggcgcctggaagttctataccagttacacgctgaaaaccttcgacggcaaacgttatctggaacactttgaagatcgggtgacaatggtggcgttgacgctggcgcagggtgacgaaacgctggccacccaactgaccgatgaaatgctttctggtcgctttcagcccgctaccccgacttttttaaattgcggcaaacagcagcgtggggaactggtctcctgcttcctgctccgtatcgaagacaacatggagtcgatcgggcgggcggtgaattcggcgctgcaactctccaaacgcggcggcggcgtcgcgtttttactctccaatctgcgcgaggcgggcgcgccgatcaaacgcattgagaatcagtcttccggcgtgatcccggtgatgaaaatgctggaagacgcgttttcgtatgccaaccaacttggcgcgcgccagggggccggcgcggtttatctccatgcgcaccatccggatattctgcgttttctggataccaaacgagaaaacgctgacgaaaaaatccggatcaaaacgctctctctcggcgtggtgatcccggatatcaccttccggctggcgaaagaaaacgcgcaaatggcgctcttttcgccctatgacatacaacgacgctacggcaaaccgtttggcgatatcgccattagcgaacggtacgatgaattaattgccgatccgcacgtgcgcaaaacctatattaacgcccgtgacttttttcaaacactggcggagattcagttcgaatccgggtatccctacatcatgtttgaagatacggtaaaccgcgcgaatcccattgctggtcgcattaatatgagcaacctgtgctcagaaattttacaggtcaatagcgcttcccgttacgacgataaccttgactatacccacatcgggcatgacatctcctgcaatctcggctcgctgaatatcgctcacgtcatggattcaccggacattggccgtaccgtagaaaccgctattcgcggcctgacggcggtgtcggacatgagccatatacgcagcgtgccctcaatagccgccggtaatgccgcctctcatgccatcggtctgggccagatgaatctgcatggctatctggcgagggaaggtattgcctacggttcgccggaggcgttggatttcaccaatctctatttttacaccattacctggcatgccgtgcatacttcaatgcggctagcccgcgaacgcggcaaaaccttcgccggatttgcgcagtcgcgctatgccagcggcgactattttacgcagtatttacaggacgactggcaaccgaaaacagcgaaagtcagggcgctatttgcccgcagcggcattacgctgcccacacgagaaatgtggctaaagctgcgcgacgatgtgatgcgctatggcatctataaccaaaatttgcaggcggtgccgccgaccggttcgatttcttacattaatcatgcgacctccagcattcatccgattgtggccaaaattgagattcgcaaagagggcaaaaccgggcgtgtgtattaccccgcgccgtttatgaccaatgaaaacctggacatgtatcaggatgcttacgatatcggtccggaaaaaattattgatacctatgccgaggccacgcgccacgtcgatcaagggctgtcgctcaccctgtttttccccgataccgccacgacccgcgatatcaacaaggcgcagatctatgcctggcgaaaaggtattaagtccctgtattacatccggcttcgccagttggcgctggaaggtactgaaattgaaggctgcgtatcctgcgcgctataaggaaagccatatgaaattatctcgtattagcgccatcaactggaacaagatccaggacgacaaagatctggaggtatggaaccggctgaccagtaacttctggctgccggaaaaagtgccgttatcgaatgatattccggcctggcagacgctgagcgccgccgaacagcagctcaccattcgcgtgtttacgggacttacgctgctcgacactatccagaacatcgcaggcgcgccgtcgttaatggcagatgccatcacgccgcatgaagaggcagtgctgtcgaacatcagctttatggaagcggtacacgcccgctcttacagttctattttctccacgctgtgccagacgaaagaggttgatgccgcctacgcctggagcgaagaaaacccaccgcttcagcgtaaggcgcagattattttagctcattacgtcagcgatgaaccgctaaagaaaaagattgccagcgtctttttagagtcttttctgttctattccggcttctggttgccgatgtatttctccagccgcggtaagctcacgaacactgccgacctgattcgtttaatcattcgcgatgaagcggttcacggttattatattggctataagtatcagatagcgctacaaaaactatcggcaatcgagcgtgaagagttaaagcttttcgcgctggatttgttgatggaactgtacgacaacgaaatccgctacacagaagcgttatatgcggaaaccggctgggttaacgacgtcaaagccttcttgtgctacaacgccaataaagccttaatgaacctgggttatgaggcgttatttccgccggagatggcagacgtgaatcccgcaatccttgccgcgctctcgccgaatgccgacgaaaaccatgatttcttttccggctcaggttcatcttatgtgatggggaaaacagtcgaaaccgaagacgaagactggaatttttaaccttacgggcatgggaaataacgttacatttcccatgcctttatttcaagcaatagggagtcaaatcgcgcaaatattacaacatgtcctacactcaatacgagtgacattattcacctggattcccccaattcaggtggatttttgctggttgttccaaaaaatatctcttcctccccattcgcgttcagcccttatatcatgggaaatcacagccgatagcacctcgcaatattcatgccagaagcaaattcagggttgtctcagattctgagtatgttagggtagaaaaaggtaactatttctatcaggtaacatatcgacataagtaaataacaggaatcattctattgcatggcaattaaattagaagtgaagaatctgtataaaatatttggagagcatccgcagcgtgccttcaaatatattgaaaagggactatcgaaagagcaaatactggaaaaaacggggctatcgcttggcgttaaagacgccagtctggccattgaagaaggcgagatatttgtcatcatgggattatccggctcgggtaaatccacaatggtacgccttctcaatcgcctgattgaacccacccgcggacaggtactgattgacggcgttgatattgccaaaatatcagacgctgagcttcgcgaggtgcgcaggaaaaagattgcgatggtcttccagtcatttgcgctcatgccgcatatgaccgtgctggataatacggcattcggtatggaattagcgggcatcgcggcgcaagagcgtcgcgaaaaagcgctggacgccttgcgtcaggtggggcttgagaattacgctcacgcctacccggatgaactttccggtgggatgcgtcagcgtgttgggcttgcccgcgcgctggcaatcaaccctgatatcttattaatggatgaagcgttttccgccctcgatccattaattcgtaccgaaatgcaggatgagctggtgaaattacaggcgaaacatcagcgcaccattgtctttatttcccacgatcttgatgaggctatgcgtattggcgacaggattgccattatgcaaaatggcgaggtcgtacaggttggtacgccggatgagatcctgaataatccggcaaatgattatgtccgcacgttcttccgtggcgtggatattagtcaggtctttagcgccaaagatattgcccgtcgcagcccggtcggattaattcgtaaaacgccaggtttcggtccccgttcggcactgaaattattacaggacgaagaccgtgaatatggttacgtcattgagcgtggcaataaattcgtgggcgtcgtgtccatcgactcattaaaagcggcattaagccaggcgcaagggattgaagcggcgcttatcgacgaccctttagtcgttgatgcgcaaaccccactcagcgagttgctctctcacgtcggccaggcgccctgcgcggtgccggttgtcgatgaagaacaccagtatgttggcattatttcaaaacgtatgttgctacaggctttagatcgcgaggggggtaacaatggctgatcaaacgaatccgtgggataccgcacaggtggccgatactacgacgcaaacggctgatgcctggggaacaccggcaggcgtagccacggacggcggcagtaccgactggttgaacagcgcgcccgcgccagcccctgaacacttttctcttctggacccgttccataagacgctgatcccgctggatagctgggtcacagagggaatcgactgggtcgtcacccatttccgtcccctttttcaggggattcgtgtgccggtggattacatcctcaacggctttcagcaactgctgctgggaatgcccgcccctgtggcgattattctctttgcgctgattgcctggcaggtttccggcgtgggcatggggatcgcgacgctgatatcgctgatcgccatcggcgcgatcggcgcctggtcgcaggcgatgattaccctggcgctggtattgaccgccctgttgttctgcgtcgtgatcggattaccgatgggaatctggctggcgcgcagcccgcgcgcagccaaaatagttcgtccgctgctggatgcgatgcagaccacgcccgcgtttgtctatctggtgccgattgtcatgttattcggcatcggtaacgtgccgggcgtggtggtgacgattatttttgctctaccgccgattgtacgcctgacgatcctgggcattaaccaggtgcctgccgacttaattgaagcgtcgcgctcgttcggcgccagcccgcgccaaatgttgttcaaagtgcaactaccgctggcgatgcccaccattatggcaggcgttaatcagacgctgatgctggctctctcgatggtcgtcatcgcctcgatgattgcggtcggcggacttggccagatggtactacgcggcattggtcgtcttgatatggggctggcaaccgtcggcggcgtcggcattgtgattcttgccatcattctggaccgtctgacgcaggccgtcgggcgcgactcgcgtagccgcggtaaccgtcgctggtataccaccggtcctgttgggctaatcacccgccctttcgttaagtaactctcctgacgcccggtgacattgcgcttaccgggcttacaactccctaccataattaaaggaacaacgatgcgacataccgtgatatttgcctcagcgtttgccacccttgtcaccgccagcgctttcgctgccgacctgcctggcaaaggcattaccgtccaacctatccaaagcacgatttctgaagagaccttccagacgttactggtcagtcgggcgctggaaaagttgggttataccgtaaataagccgagtgaagtcgattacaacgtaggctacacctccatcgcctctggcgatgcgacgtttaccgccgtgaactggcaaccgctgcatgatgatatgtatgccgcagcaggcggagacaacaagttttaccgcgagggcgtcttcgtctccggcgctgcgcagggctatctgatcgataaaaaaaccgccgagcagtacaacatcaccaatatcgctcagctaaaagatccgaaaatcgccaaaatcttcgatactaatggcgacggaaaagcggacatgatgggctgctcgccgggctggggctgcgaagccgtaatcaatcaccagaataaagcgtttgatttgcaaaaaaccgttgaggtcagccacggtaactatgcggcgatgatggctgataccattacccgttttaaagaaggcaagccggtgctgtattacacctggaccccgtactgggtgagcgatgtaatgaagccgggtaaagatgtcgtctggctacaggtgccgttctcctccctgccaggcgaacagaaaaatattgatactaaactgccgaacggcgcgaactatgggttcccggttaataccatgcatattgtcgccaataaggcatgggcggagaaaaatccggcggcggcgaaactgttcgccatcatgaagctgccgctggcggatatcaacgcgcagaacgccatgatgcatgccggtaaatcgtctgaagccgatgttcagggccacgtagacggctggatcaacgcccaccagcagcagtttgacggctgggtgaaagaagcgctggccgcgcagaaataagatcgttttttatgccggataaggcgcagttcatgcgccgctatccggccaacgcaatctctcctcaaagcgcacgattcatcacgtcaccgttcccctttattcatcaacatccgctatgattgttttcccaggaaataattatctgaatcacgattaccataatgacgaaacccactcatgagcttagcccggcgctgatcgttttaatgtctgtggccacgggtctggcggtcgccagcaactactatgcccagccgctgcttgataccatcgcgcatcacttttcgctttccgccagctccgcagggtttatcgttaccgccgcgcagttgggctatgccgctggcctgttgtttctggtgccgctcggcgacatgtttgaacgccgaacgctgattgtctccatgacgttgctggcggctggcggaatgctgatcaccgccagcagtcagtcgcttagcatgatgatactcggaacggccttaaccggactgttctccgtggtggcgcagattctggttccgctggccgccacacttgcgacgcccgccacccgcggtaaagtggtcggcaccattatgagcggcctgttgctggggatcctgctggcgcgaacggtcgccggactgctggcaaacctcggcggttggcgcaccgtattttgggtagcgtcggcgctgatggcgctgatggccgtcgcgttatggcgcggactgccaaagctcaaatccgacacccatcttaactacccgcaactgttgggttctgtattcagcctgtttattcacgataagctgctgcgtacccgcgcactgctgggctgtctgacctttgctaatttcagcatcctctggacatcaatggcctttttgctcgccgcgccgccgtttagctactccgaggggatgattggcctgtttggcctggcgggggccgccggcgctttaggcgcgcgtccggctggcggatttgccgataaaggtaaatctcacctcaccaccacgttcggcttactgctgctgttactctcctggctggctatctggcttgggcacacctcggtactggcgctgattattggcattctggtactggacctcaccgttcagggggtacatatcaccaatcagacggtcatctatcgtttgcatccggatgcgcgtaaccggctcaccgccggctatatgaccagctactttatcggtggcgccgcggggtcgctgatttccgcctccgcctggcaacatgccggctgggccggcgtttgtctggcgggtgtcacggtagccttacttaatttactggtctggtggcgaggttttcaccgacaggaagccgtaaattaagcggatagtgagcgtttacctttgtttaagctccttagggtgttaaggagctccccagtctgttaaggttatgctattcatttatcatggttatttttataccggtgaagaataatataattctatggaaagccctgcatccccatctgctcccaggccaatagcgcccgttcaaggattcgaaggtcgttcaccgatagctatccgtgatattccggtggcttttgcatcgggttgtaaggccgtttacccggctttcgcccctcccgcttatcgttctctcctgattttttcatgcaggcactcacgcttttctcgtcattcctggatttgccgcaggcggcgctttaccgggcccaatgttcccgctgacgtctcagtctgcgtatcattggttgctttatagcctgaaagaatgattttgtattaataatacatttactttatttgtcactgtcgttactatatcggctgaaattaatgaggtcatgcccaaatggatagttcgtttacgcccattgaacaaatgctaaaatttcgcgccagccgtcacgaagactttccttatcaggaaattcttttgactcgtctttgtatgcacatgcaaggcaagctcctggaaaaccgcaataagatgctgaaggctcaagggattaacgagacgttgtttatggcgttgattacgctggagtctcaggaaaaccacagtattcagccgtctgaattaagctgcgcgctgggttcatctcgcaccaatgcgacacgcattgcagatgagctggaaaaacgcggctggattgagcgtcgtgagagcgataacgaccgccgttgcctgcatctgcaattaacggagaaaggccaggcatttttgcaagaagtgcttccgcctcagcatcattgtctgcatcaactctggtcatcacttagcacagccgaaaaagatcaacttgagcacatcactcgtaaactcctgacgcgtcttgatcaaatggagcaggaaggcactgttcttgaggcgctgcgctaaagcgccgacccgctcaaaaatccagattaataacaggaaagcggacaggccggcacgcgttactgctggcctttctgacaacaggtcggctcagccgatgtgaataataagatcgtggagaacaacatgagcgcaaatgcggagatccaaaccccgcagcaaccggctaagaagaaaggcaaacgcaaaacagcgctgctacttcttaccttgctctttgttattattgccgtggcatatggaatttattggtttttagtattgcgtcatattgaagagacagatgatgcttacgtggcagggaaccaggttcaaatcatggcgcaggtgtcaggcagcgtgacgaaagtctgggctgataacaccgactttgtaaaagagggcgatgttctggtcacgctcgatcagactgacgccaaacaagcgtttgaaaaagccaaaacggcgctggcctccagtgtgcgccagacgcaccagttgatgattaacagcaagcagttgcaggcgaatatcgacgtgcaaaaaaccgccctggcgcaagcgcaaagcgaccttaaccgtcgtgtgccgctgggtaatgccaatcttattggccgggaagagctgcaacacgcccgcgatgccgtcgccagcgcgcaggcacagctggatgtcgccattcaacagtacaatgccaaccaggcaatgatactcaacagtaatctggaagatcagcccgcggttcaacaagcggcgaccgaagtgcgtaacgcctggctggcgctggagcgtactcgcatcgtcagcccaatgactggttatgtctcccgccgcgccgtccagcctggcgcgcaaatcagccccaccacgccgctgatggccgtggtgcctgcaaccgatctgtgggtggacgctaactttaaagaaacccaattagcgaatatgcgcattgggcagccagtgacggtgattactgatatttatggcgacgacgtaaaatacaccggtaaagtcgtcggtctggatatgggaacaggcagcgccttctccctgctgcccgcgcaaaatgcgacgggtaactggattaaagtggttcaacgtctgccggtacgcgtcgaactggacgcccgccagttagaacaacatccgctgcgtattggtttatcgacgctggtcaccgtggataccgctaatcgcgacggtcaggtactggccagccaggtacgaacgacgccggttgccgaaagtaacgcacgcgaaattaatctcgcgccggtcaataaactgatcgacgacatcgtacaggctaacgcgggttaatcctgaggtgcgtgtgatgcaacagcaaaaaccgctggagggcgcgcagctcgtcatcatgacgatcgcgctgtcgctggcgacattcatgcaggtgctggactccaccattgccaacgtggcgattccgaccatcgccgggaacctgggttcttccctaagccaggggacatgggttatcacctctttcggggtggcgaacgctatctcgattcccttaaccggctggctggcgaaacgttttggcgaagtcaaactgttcatgtggtcgacggtcgcctttgccgcggcctcctgggcctgtggcgtatccagcagcctgaatatgctgatcttcttccgcgtggtgcagggcgtggtcgccgggccgctgattccgctctcgcaaagcctgttgctgaataactatccgcctgcaaagcgctccattgcgctggcgctctggtcaatgaccgtcattgtcgcgccgatttgcggcccgattctggggggctacatcagtgataattaccactggggatggattttcttcatcaacgttccgattggcatcgccgtcgtcctgatgacgttacacacgctgcgcggacgtgaaacgcataccgaacggcgacgtattgacgccgtcgggctggcgctactggtgattggcatcggcagcctgcaaattatgctcgatcgcggtaaagagctggactggttctcctcgcaggaaattatcatcctgaccgtggtcgccgtcatcgccatcagtttcctgatcgtctgggaactgaccgacgatcaccctatcgtcgatctttctctttttaaatcgcgtaacttcacgattggctgcttgtgcatcagccttgcctatatgctctatttcggcgccattgttctattgccgcagcttttgcaagaggtgtacggctataccgcaacgtgggcaggtctggcgtcagcgccagtcggtattattccggtaattttgtcgccgattatcggacgcttcgcgcataaactggatatgcgcaggctggtcacgttcagcttcattatgtacgccgtctgtttttactggcgcgcctggacgttcgaaccgggtatggatttcggcgcttccgcatggccgcagtttattcagggatttgccgtcgcctgcttctttatgccgctgaccaccattacgctctccgggttaccgccagaacggctggcggcggcatcaagcctgtcgaacttcacgcgaacgctggcaggttccatcggcacctcgattaccaccactatgtggaccgatcgtgagtcgctacaccatgctcagctcaccgagtcggttacggcgtataatccaaacgctcagactatgtacgataaactggaaggcttagggatgacgcaccaacaggcgtcaggctggatagcccagcaaatcacgaatcaggggctgattatttccgccaacgaaatcttctggatgtcggcggggatcttcctggtgctgctcggcctggtgtggttcgccaaaccgcccttcggtgcgggcggcggcggtggcggcgcgcactaactatctgataaaagggatctgcggatcccttttttagtagaccaacaatcagaagaaatatttgaatctcagacgcccgccgtaacgcgcatcttcactgttatcgccattattcggattggcctctacccatgaagcataggcaccgaggtagatgttaaagtttttcatatccatcacgttggggaataaatatgaggcatgaatagtgtgaatgtcataattgccgggatcggtgacccagcaatcgtcctcacaaacggcatcgatattggtagcattaaaggcttcgattttgttatgcgcatagatataacccagttcaaatcgatgccacaacgcattcaccccggcggtaaaatctgtctcatcggtcgcgtccatataggcggtattcaggttaatcactgcgccatcttccgggtcagttttttgaccattccaggtcatggtaaaaccatagcccgtacgatctgactgatcgatccacttcccattctcataatagccataggcgttgttaacgacgttactttccatcgctatcgccgttgaaaaacgcccgttttgccaggcgataaccggacggacgtaagccacgtttttatcgttgcttaaatccattccgtggtactgcttctcggtatataacgtactgccattttccagcaatgtgttaacttcgaaataccagttgtcgatggttttactcagcaggaagttacccccgctgtcgctacgtccccgtccttctttcatcatatagatatagccgtaaccgtcactgtaaagatcgttcgctgtattccccgaatattcaataaacgtatcctgattcagcgggaacatatcgtaggcttcaaaacgaccaaccttaattttccagtcattctcacgaccaaagaagaaaacggcatcatcaaggttcatttttccggtcaggtccgccagaggctgtacagagaatccggcaaaattaccgttgtccagccgctggtagccatcaaagcccagcaacaggcgtccgttaatatcccagcgttcattggttcccggtgcccaatctttattcgctgacgttctcgtcgatgtcagactaccggaacggcttgccgcatccatattaaattcgacatcgccatagaacttaatatcgctgaatccggataaagtcagcttcggcggcgttttatctgctgcaatgggctcggcggactggacattcaccgtcggcgtagcggcgacctgctgctgtttcaacgagcgaatttgcgcctcggcatcggatgcccgtttttcagcattaacaacacgttgctccagttcagccagacgctgctcaatagtgatattattcgctgcccaaaggttatgagaaaagcaagcaccgatcatcagcgctaaatatttagccttcattttttatcccttaagtttgatgtataccagataagatttgctaaaaaccccatcgaccggctattagtagagtcttgttattacctggatatctggcgcattccattatgtttttctattaattatttatgatttttagtttatgtgatcaatacactctggcatcgtgagttatccgccttttctgtttaccagatcacattttattatttaacaggccaggcattacttaatttaaaatgtattctcgccgcaaatataataaacgcaaattatattaagcaataaaaaaccccggccataaaccggggttaatttaaatactggaaccgcttacaaataagactaaatatgcagttcctgcagtttttctttcggcagcgccagctctttattgctgttcacgcgcacatcacgctccagaatatgacgggcaatgtcctgcgcttcactgagcgagtgcatctgatacgtaccgcactggtaaacgttcagctccgggatctggttttgatcctgcactttcagcacatccgccatcgccgctttccaggcgtcggcaacacgctgctcgtccggcgtgccaatcaggctcatgtaaaagccggtgcggcagcccatcggcgagatatcgataatctcaacgccgttaccgttgaggtggtcgcgcataaagccagcaaacagatgctcaagcgtatgaatccctttttccggcatcacttctttgttcggaatgcaaaaacgcagatcaaacacggtgattgcgtcgccatgcggggtgttcatcgtttttgcaacccggaccgccggcgcttgcatccgggtatgatcgactgcgaagctatctaataatggcatttagtcacctccgataattttttaaaaataaactgaactctttgttccggggcgagtctgagtatatgaaagacgcgcatttgttatcatcatccctgttttcagcgatgaaattttggccactccgtgagtggcctttttcttttgggtcaggcgtgttttgcaagccacgcggcaaacggctcggtatccgccgcctcaatctcctgctgacgacgtactgaagcgtcacgttcagcaataaactcttcttcctgtaaaatctccagcggctcttcgcgtaacagattacggtaagcctcaccgaacgctttcccggtgccgccaatgccttcatcaatcatagaccgtaggatccgggcggagaatgtcagttcaggattatcaaagcaggcgaccaactcgtcacacaccttttgatactcctctcccccgtggatactgtccagcgtttgcgccacgcgtttcagatcgcggaaaagatctttcccgactttgggcagcgggaactgcgcagtttcacagccaatgcctaacgtcaggcccggcttacgcccttccagaataacgcgattccagttagtacgcgtacataacagctcatcgctactcatttccggcgcatcggccaatacgcaccagaccataaacagatcgaggaagcgcacctgttgctcgtctacgccgatcggtgagaacggattaatatcgagagaacgaacttcaatatactcaataccaccacgcagaagcgcgtcagaaggcgattcgccgctgcgcgtcacgcgcttgggacgaatgggcgcgtacagctcattttcaatttgcagaacgttgctgttaatctgtagccgcttaccgtctttttccacaccaatccgtgcgtactcctcggaaggggttttaatcgcgcgcttcagacctgcaacgtattcatgcaaatcgttaaacgtaattccgagattgctttgcgacttattggtatagcccaaatcactcaaacgcagcgacgtcgcatacggcaggtagtacatgccgcagtccgttttttcaaacggtaatgtggttggctttccttgcaggaaagaggaacaaatggccggagacgcgccaaacagataggggatgacccagccaaaacggtaatagttgcgaatcagacgaaaatagccggcagaaattttttcttttgccgcttcgccttccgtaacgccgcatttcgcctgccagaacgccatcggtaatgaaaaattgtaatgtacgccggagatggtttgcatcaaagcgccataacgatttttcagcccttcgcgatagagcgtcttaaaacgcccggtattggatgtgccgtactgcgccagctctatgtcctgcccttccgcaatatagcagggcatacttaatggccacatccgctcatcgcccagtttcctggccgtataccgatggagatcgcgcataaaggtgagcatatgctggatatcgccatcgactggcgtaataaactccagtagggcttccgcaaaatctgtggtaatccatttatgggtcagcgctgaacctaacgcttcaggatgacctgttgtcgccagcgtgccatcagcattgacacgcagcgtttcgcgctctaacccgcgctgtatcccctttaacgcctgaggatgtttttccagccaggccagagcctgtgatacgtccgggatcaaattgacctcccgcctgtccaaatcgttttaataagcataactgtaatggcggccatacatgccaaacctacaattattaccaccacatcatgccctgaaccgtcgccgctgcgagcgcaacatagcgcagcgccttaccaagacacaaaaaaaagatcgtccgcccccacgggatgcgcatccatcccgctaacaggcacaacaaatcaccgatgaccggcatccagcttaataatagtgtggctgcgccataacgctttagccagccagtcgctttttcctgccaacgcgacgttttgcgcagcggaaagaaacgcccaagaataacgttagttacccctccaaggctattacccattgttgctgttaagactaagacccagggatggctgacgccggagaccagcatagcaaccaaaaccacctcagaattaccgggtaacagcgtcgcgctgagaaaactactggcaaacagagacaggagcgacagtccgtcactcacaatagtcggacatccacggcatccattcccgccgcccgcgccgcctgtaaaccaaaatcggcatcttcaaataccacgcactgcgtcggcatgacgcccatccgctgggcgcacagtaggaaggtgtcaggcgcaggtttgtgatgctgtacgtgatctgccgccacaaccgcatcaaaataacgacgcagccccagatgcgctaacagggcttccgcgatagcgctttcgctaccggtaccgaccgacatgggacgccgcccatgccacgctttaaccacctcaaccagcggcagcggttctacgcagtccagcaggatgctttttaccgcgtcggttttctcacgcgccagtgacaggggatcaagatcggcatggttaagctcaatgattgactgggcgataagccaggttggcgaaccgttaagcgcgaccattgcctgttcatcaaaacgaagaccatagcgccccaaaacctcacgccacgctttgcgatgcgtgggttcggtatccaggagagtaccgtccatatcaaaaatcaaaccagcataacgtgcgtacatcgtgttctcgcaaaccgaataaccagacagtactttatcgcaattggttgattttgtcgctaatagagatgaagaggtatattcaggataagggggaaaagcgattgcagggcagtaacgtatccgggaggattactcgcccttcgggccgttgctgatgcaacgttatccttctgatgccagcggtgattaccgctatcttatctgcatcttcatcgctgaaagtatggagaatatggtgcatccgggaggattactcgccttacggctcgcccttcgggccgttgctgacgcaacgttatccttcctggtgccagcggtgattataactatcttatctgcatcttcatcgctgaaagtacggagaatatggtgcatccgggaggattcgaacctccgaccgctcggttcgtagccgagtactctatccagctgagctacggatgcattggaaatgatgtttactacaagatttgatgtcgcatttactgccacactaaataagatggtgcatccgggaggattactcgccttacggctcgcccttcgggccgttgctgacgcaacgttatccttcctggtgccagcggtgattaccgctatcttatccgtatcttcatcactgaaagtacggagaatatggtgcatccgggaggattcgaacctccgaccgctcggttcgtagccgagtactctatccagctgagctacggatgcatcggaaaacttgctttactgccgatattgataccgcggtgaaagccgtatcaagtaagagatggtgcatccgggaggattcgaacctccgaccgctcggttcgtagccgagtactctatccagctgagctacggatgcatcgggaaacttactttactgcagattttgataccgcggtgaaagccgtatcaggtaagagatggtgcatccgggaggattcgaacctccgaccgctcggttcgtagccgagtactctatccagctgagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgttctgctcatcgtcgctgcgtggcgcacatattactttctgggacttataagtcaaacaatttttccagagcttttatcgtttgcacacttcacgctcaattagtctgtaaaaaagccaaaaagagtgttttatcaacagataatttgatgacacgctggccgccaaaagcgcaccatatcaacagtgaggttgaaaaaagtcatgaagggacaacgcgggcgagcgagaagagaggctgcgtctcacccgaaaagtgagacgcgaaaaccttagtaactggactgctgggatttttcagcctggatacgctggtagatctcttcacgatggacagaaacttctttcggggcgttcacgccaatacgcacctggttgcccttcacccctaaaactgtcacggtgacctcatcgccaatcatgagggtctcaccaactcgacgagtcagaatcagcattctttgctccttgaaagattaaaagagtcgggtctctctgtatcccggcattatccatcatataacgccaaaaagtaagcgatgacaaacaccttaggtgtaagcagtcatggcattacattctgttaaacctaagtttagccgatatacaaaacttcaacctgactttatcgttgtcgatagcgttgacgtaaacgccgcagcacgggctgcggcgccaacgaacgcttataattattgcaattttgcgctgacccagccttgtacactggctaacgctgcaggcagagctgccgcatccgtaccaccggcttgcgccatgtccggacgaccgccacccttaccgcccacctgctgagcgaccatcccaatcaattcccctgctttaacccggtcggtcacatccttcgacacgcccgcaatcagagaaaccttaccttcaacaaccgttgccagtacgataacggtagaccccagttgatttttcagatcatcaaccatggttcgcagcattttcggctcaataccagcaagctcgctaaccaggagcttcacgccgttgagatcgaccgctttactggaaagatttgcactctcctgcgctgcggcctggtccttcaactgctgcaactctttttccagctgacgtgtacgttccagcacggcacgcactttgtcgcccagattctggctgtcgcccttcagcagatgcgcaatatcgtttaagcgatcgctttgcgcatgaacggtggccatagcgccttcaccggttaccgcctcaatacgacgaatgcccgctgcggtgccggactcagagataatacggaatagaccgatatcaccggtacgactggcgtgagtaccgccgcacagttcagtagagaaatcgcccatgctcagaacgcgtacacgttcgtcatatttctcgccaaacagcgccatggcccctttcgccttcgccgcgtcgagatccatgatgttcgtttcaatcggcaggttgcggcgaatttgcgcattcaccaaatcttcaacctcacgaatctccgacggcttcatcgcttcattgtgcgagaagtcgaagcgcagcactttatcgctaaccagcgaacctttctgcgcaacgtgtgtcccaagcacctggcgcaacgccgcgtgcatcaggtgcgtggcggagtggttcagacggatacgtgcgcggcgcgcttcatctacgtcagcctgtaccgcatcgcccactttcagagcgcccgcagacaatttgccgaggtgaccaatcgcctgaccatatttttgcgtgtcgtccacagcgaaagtaaatccagcgcctttcagctcgcctttatcgccaacctgaccgcctgattccgcatagaatggggtctgatccagcacgacaaccgcttcctgtcccgcgttaatcgcttcaaccgctttaccatcgacaaacagcgcagtcactttgccgttcagttccagatggtcataacctttaaattcagaagcgctatcaacgcggatcatcgcgttgtagtccgcgccaaaaccgctagcttcgcgcgcgcgacggcgttgctcttccatagcggcttcaaaaccggcttcatcgactttgatgttgcgctcacggcagacgtccgccgttagatcgaccgggaaaccataagtatcatacagacggaaagcggtttcgccgtccagggtgtcgccctgcaatttcgccagttcttcatccagcagcgccagaccgcgctccagcgtacgggcgaactgctcttcttccgttttcagaacctgttcgacctgcgcctgctgacgtttcaactcttcgcctgcggagcccattacctcaatcagcggcccaaccagcttgtagaagaaggtctctttcgcgcccagcatgttgccgtgacgaaccgcgcgacgaataatgcgacgcagcacatagccacggttttcattcgacggcagcacgccatcggcaaccaggaatgcgcaagaacggatgtggtcggcgataacgcgcagcgatttattacccagatcggtggcgccagtgactttcgctaccgcttcaatcaacgtgcggaacaggtcgatgtcatagttagagttaacgtgttgcagtaccgcggcaatacgctccagccccataccggtatctacagacggtttcggcaatggttccatcgtcccgtcagcctgacggttgaactgcataaagacgatgttccagatctcaatatagcgatcgccgtcttcttccgggcttcccggagggccgccccagatgtggtcgccatgatcgtagaagatttcggtgcacggaccgcagggaccggtgtcgcccatctgccagaagttatccgatgcgtatggcgcgcctttattgtcgccgatacggataatacgctcgcgcgggatgccgacttctttttcccagatctcataggcttcgtcgtcggtttcatagacggtgacccataaacgctcttttggcagagcaaaccagttttcaccggtcagtaattcccatgcgaactgaatggcgtcgtgtttgaagtaatcgccgaagctgaagttgcccagcatttcgaagaaagtatggtgacgtgcagtgtatccgacgttttccagatcgttgtgtttacctcccgcgcgtacgcaacgctgggaagtggttgcacgggaataattacgtttatcgagcccaaggaaaacatccttgaactggttcatcccggcattggtaaacaacagagtggggtcattgttaggcaccagggaactgctggcaactacctgatgccctttactatggaaaaagtcgagaaacgcctgacggatctcagcggtgctcttgctcataattatcctgaaatcaagctacacttcatccttcaggccgcctctgcgttggctgcgagtttcccggtcacgcgttcccgaggctcacttgccgctttgatgcggcttgaatgattttgtgtatttaaggaatattcgtcgcagacgctgttcgccgttaagcaacccgcgtccagacggaaaaagtgggaataagataagttttctttaccgggaagtaaaatcccgtatgcgctcaatctgcaaaatttcgccatatttgctggatattgtccatcagatacccgcgatagagcaaaaagcgctgtaccttaaccttttctgaaaagtttgaagggagcggctcgccatatttgcgaacggcctgttcacgtgccatttcactccagtcaatttcacattctcgcatcgctttttcagtcgattcacgggaaatgcctttctgattcaactcctggcgaatacgcgccgggccatagcctttgcggctacgactggcgataaagcgcatcacgaagcgctcgtcatcaagatagtgatgttcgtggcaccaggcgatcacgcgttcataatcgtctgccgtcgcatcaatctcttccggcccatttttgcccatcaccggcgcggagagtttacgccgtaattcctgctcgctgtgatcgcggacagcaagaatacgtaccgcacgatcaaggagacgagcataagcgggacggcgcgatgtgggttcactcataaaaaaccttaacagggagaaatgccaaaagggccgcataaatgcagcccttgatggtaatttaacgttttgctgaatggcggcttcgttttgcccgccccaccatcacctgatgattaaaaatcttcgttggtttctgcaacgccttcgctatcgtcaacggcgaaatcgggcgtggcattctgattactcaacagtaattcacgaacccttttctcgatctctttcgctgtcgccgggttctctttcagccaggtagtcgcgttcgctttaccctggccaatcttctcgccgttgtagctgtaccatgcgcccgctttctcgatcagcttctctttcacgcccaggtcaaccagttcgccatagaagttgatgccttcaccgtagaggatctggaactcggcctgcttaaacggcgcggcgattttgtttttcaccactttcacacgcgtttcgctacccacgacattatcgccctctttcaccgcgccaatacgacggatatcaagacgaacagaggcgtagaatttcagcgcgttaccgccggtggtggtttccgggttaccgaacatcacgccaatcttcatacggatctggttgatgaaaatcaacagcgtgttggactgtttcaggttccccgccagcttacgcatcgcctggctcatcatacgcgccgcgaggcccatgtgagagtcgccgatttcgccttcgatttccgctttcggcgttagcgccgctacggagtcgaccacaatgacgtccaccgcgcctgaacgcgccagcgcgtcacagatttccagcgcctgctcgccggtatccggctgagagcagagcaggttatcgatatcgacgcccagcttgcgtgcgtaaacagggtcaagcgcgtgttccgcatcgataaacgcacaggttttaccttcacgctgcgcagcggcaatcacctgcagcgtcagggtcgttttaccggaagattccggcccgtaaatttcgacgatacgccccatcggcagaccgcccgcaccgagtgcgatgtccagtgaaagcgaaccggtggagatagtttccacatccatagaacggtcttcacccagacgcatgatggagcctttaccaaattgcttttcaatttggcccagtgctgccgccaacgctttctgtttgttttcgtcgatagccattattactcctgtcatgcaacttggtattgaaccggatagtgaattcgtactgttgaagcaattatactgtatgctcatacagtatcaagtgttttgtagaaattgttgccacagggtttgtagcgcgtatgtcgtcgcctgtcgacgcaccgattcacggtcgccgctgaagcattcccgacgcgtaatcccttctccactgacgctggcgaaagcaaaccacaccgtaccaaccggcttttcttcactgccgccatccggcccggcaatcccgctaatagcgacagcaaaatcggcgcgagcggccttcagcgccccgatcgccatttcgaccactacgggttcgctgaccgcgccatgctgcgccagagtctcttcacgcacgccaatcatctgcgctttggcttcattactataggtgacaaagccgcgttcaaaccaggcggaacttccggcgatgtcggtaatggctttcgccagccagccgccggtacaggactctgctgtcgttacggtcgccccgcgcgcttttaacgccagcccgacctgctcgctaagccgcatcagttcactgtcagtcatcatgacctctgtcagttagaaatcctgccgcacaagatagcactttctcaccagagatggggacgagctgtcgattttacgagtcggattccgaaaaaatgccagcaggttatttatgcagaatgaaagaggtagcacttgactaaatagcagtaccatgtcgctaaatttacacgtacggagagaaagcaaggatgtcactcaaaaaaacggaaagcacacagcacaaactgaaacaaacctgtcaactacggctgtggttaattgtgggtggagtatgttcattaggaatgggagtactgaatatattgtcgtcaggctattttgaaccgtatgacggcggtcaaattatcttaggcctgggatgtctgggatatagtctggcactatcaaagaagatatcccacttgcaggcagagaatcagcccaaaaagccataataatagcggagggggtgctcccctccctaagcgtaaattagcgcacccgcgccagcgctaccgcctggcccagttgccaaaccgccatcgcataatgcgtgctgtggttatatcgggtaattgtgtagaagttcggcaggccgtaccagtactggtatcccgtaccgatatccagacgcagcaggctggcttcctgatgattgcccaacgattgctgcggcgttaagcctgcggcggcaagctgagagatgctgtattttgttttgaaaccattcgccaacccaggcgcctgaccactcgccggcaccgcaaccatatcgcctttcacccaaccatgcgccttgaaatagttcgccacgctgccgatggcatctaccggatcccacaagttaatgtgcccatcaccattgaaatcgaccgcatattctttataggaagatggcataaactggccgtagcccatcgcgcccgcaaaggaacctttcagattgagcggatcgtcttgctcatcgcgcgccatgagcaggaaggtttccagctcgccggagaaatattccgcccggcgcggatagttaaatgacagcgtcgccagcgcgtccagaatccgcgttttccccatgatacgtccccagcgggtttccacgccgatgatgcccacgatgatctccggcggtacgccgtatacctgccaggcgcggttcagcgcgtcttcatactgattccagaacgcgacgccgttttgcacgttatccggcgtaataaattgtttgcggtagcgcaaccaggcgccatttggtccggcgggcggctgagtggtcggcgcttgtctgtccatcagacgcaggacgtaatccagtcttttagactgcgagaggatctcttgcaactgctgacggtcgaaaccgtgtttactgaccattttatcaatgaactgctgcgcattagggttgttggcgaagtcgccgcccatttgcatgacgttatgctgcggctcaagcagaaagccgccggaaggcgtgcccgtcgtcgcttgagtctcggaagattttggcgtgctgctacaggcagcaagcaatacgcaaagtggaagtaacgctacataacgacgcttgaacatgagacatccattaaacaaattcagccagggagaagtatggtaaagcatcccccgccgcacaaggaagcggcacaagagaataaatcacctttctcctcttttcagtttgtatacgctccctcactcccacaatctttcaatttaaaatatttttcttttattttgcgatcacaataacacttttaaatctttcaacatgattacaatgaacaggaaattagcaagaaaactaaaaaccctacaggagagaacaatgatcgaaaccattacacatggtgcggagtggttcatcgggttattccagaaaggcggagaggtgtttaccggtatggtgacaggtattcttccgctactgataagcctgctggttatcatgaatgcgctcatcaattttatcggccagcagcgtattgagcgttttgcccaacgttgtgccggaaatccgctatctcgttacctgcttttaccgtgtatcgggacatttgttttttgtaatccgatgaccctgagtttgggacgctttatgccggagaagtacaagccgagctattacgcggcggcctcctatagctgtcactccatgaacggtctgtttccgcatatcaatcccggcgaactgtttgtttatctggggatcgccagcggactcaccacgttagggcttcctctcggcccgctcgcggtgagctatctgctggtaggtctggtgacgaacttcttccgcggttgggtcaccgatctcaccaccgctatttttgagaaaaaaatggggattcaacttgagcagaaagttcatctgacaggagcggtatcatgacacgggttcgcattgagaaaggcgccggcggctggggcggcccgcttgaactggacgttacgccagacaaaaagatcgtctatatcacagccggtacgcgcccggcgatcgtcgacaaactggcgcaactaacaggctggcaagcggtggacggctttaaagaaggcgaaccgccggaagcggagatcggcgcggccattatcgactgcggcggtacgctgcgctgcggtatctatccgaaacgccggattccaaccattaatattcactcgacgggtaagtccggcccactggcgcagtatattgttgaggatatttatgtctccggcgtaaaagaagaaaacattactcttgtcggcgaaacgcctgccagtccccagcctgccaaaacgacattaggacgtgactacgacaccagcaaaaaaatcaccgagcagagcgacgggctgctggcaaaagtcggtatgggaatgggctccgccgtggcggtactgttccagtccggtcgcgacaccattgatacggtcctgaaaacaatcctgccgtttatggcgttcgtttcggcgctgatcggcatcattatggcctcaggtcttggcgactggatcgcccacggcctggcgccattagccagccatccactggggctggtgacgctggcattgatctgctcgttcccgctgctgtcgccctttctcggccctggcgcggttatcgctcaggtcattggcgtcctgatcggcgttcagataggcctgggcaatatccccccgcatctggcgcttcccgccctgttcgcgattaacgcgcaggcggcctgcgactttatcccggtcggcctgtcgctggcggaagcgaaacaagacaccgttcgcgtcggcgtaccttctgtgctggtcggacgcttcctgactggcgcgcccacggtacttatcgcctggtttgtttccggctttatctatcaataagaggttcagacatgagcgtgatttatcaaaccaccatcacccgtatcggccagagcgcgaaggaagcgctcggcgaacagatgctgattacgtttcgggaaggcgcgccggcggatatcgaagaattttgcttcatccattgtcatggcgaactgaccggcgcgctgcagcctggcgcgcggtgtgaattgggtcaacattgctatccggtcacggcggtcggcagcgtagccgagcaaaacctgcgtgaactggggcatatcactttgcgcttcgatggtctgcgtgaagcggaatttcccggcaccgtacacgttgcggggcctgtaccggacgatatcgcgccgggctgtattttgacgtttgtcgcttaaggagaaaaaacatgaatcaagttgccgttgtcattggcggaggccagaccctgggggcattcctttgccgtgggcttgcagaagaaggataccgcgtggcggtcgttgatattcaaagcgataaagccgcgaatgtcgcccaggaaattaacgccgattttggcgaaggtatggcgtacggttttggcgccgacgccaccagcgagcagagcgtgctggcgctttcccgcggcgtagacgagattttcgggcgcgtcgatctgctggtttacagcgcgggtatcgccaaagcggcgtttatcagcgatttccagttgggcgattttgaccgctcgctacaggtgaatctggtgggctatttcctctgcgcccgtgagttttcccgcctgatgatccgcgacggcattcaggggcgcattattcagattaactctaaatccggcaaagtgggcagtaaacacaactccggctacagcgcggcgaaattcggcggcgtggggttaacccagtctctggcgctggatctggcggaatacggcattaccgtacactcgttgatgctcggcaacctgttgaaatcgccgatgttccagtcactgctgccgcaatacgccactaaactgggcattaagcccgatgaggtggaacagtattacattgataaagtaccgctcaaacgcgggtgtgattatcaggatgtgctgaacatgctgttattttatgccagcccgaaagcgtcttattgcaccgggcagtcgatcaacgtaaccggcggtcaagtgatgttctgaccgtgaattgccggatggcgccgtaggccggataagacggttacgcgccatcaggcaaaacaacaggagcacattatggtttccactctgattaccgtcgccgttatcgcctggtgtgcgcagctggcgctgggcggctggcagatttcccgctttaatcgggctttcgataaacttagccaacaggggcgggtcggcgtcgggcgctccggcgggcgttttaagccccgggtggtggttgccgtggcgctggacgaacagcagcgggtgacggacactttattgatgaaaggccttacggtattcgccagaccggttaaaattgccgcaatgcaaggaaaacatttgcatgaattacagcctgatgtgatctttccccatgattcgctcgcgcagaatgcactatcattggcgcttaaactgaaacatgggtaatttcgttgtgaatgcgtatagcttgcgaaattatcattttgcaaccaataccctaaataattcgagttgcaggaaggcggcgacgcagcgaatcccaggagcgtacatcagtacgtgaccggggtgagcgaggaaagccaacgcacatgcagcgtgaagtatgacgggtaaatacataagtcagggtaatcacgcctatgaaacctcgtcagcgtcaggccgcgattctggagcacctgcaaaaacagggaaaatgctcggttgaagaactggcccagtactttgacacgacaggcaccactatccgtaaagatctggtcattctggaaaatgccggaaccgtcatccgcacctatggcggcgtggtgttgaataaagaagagtccgatccgcctattgatcacaaaacgcttatcaacacccacaaaaaagcgctgatagccgcagccgctgtgaaatatatccatgatggcgattccattattctggacgccggaagtaccgtgttacagatggtgccgttgctttcgcgttttagcaacatcacggtgatgaccaacagcctccatattgttaacgcgctatcggaactggacaacgaacaaactatcctgatgcccggcggcaccttccgtaaaaaatcggcgtcgtttcacggtcaactggcggaaaacgcctttgagcaattcagctttgataaacttttcatgggaactgacggtattgacctgaatgtcggtgtgaccacgttcaatgaggtttacaccgtcagtaacgcaatgtgcaatgcagcacgcgaggtgattctgatggcggactcctcaaaatttggtcgtaaaagccccaatgtggtgtgcagtctggaaaccgtcgacaaactgatcacggacgcggggatcgatccggcatttcgtcaggcgctggaagcaaaagggattgaagtaatcataaccggagaaagcaatgagtgatgcactactaaacgcgggccgtcagaccttaatgctggagctacaggaagccagccgtctgccggagcgtctgggcgatgattttgtccgcgccgccaatatcattattcactgtgaaggcaaagtgatcgtttccggtattggtaaatcaggtcatattggtaaaaaaatcgccgcgacgcttgccagtaccggtactcccgctttttttgttcatccggcggaagcactgcatggcgatctggggatgattgaaagccgcgacgtgatgttatttatctcctattccggcggcgcaaaagaactcgacctcatcatcccgcgtctggaagataaatccgtcgcgctgctggcgatgaccggtaaacttcactctccgctggggcgagcggcaaaagccgttctggatatttccgtcgagcgtgaagcctgcccgatgcatctggcgccgacatccagtaccgtcaatacgctgatgatgggcgatgcgctggcgatggcggtcatgcaggcgcgcggttttaacgaagaagatttcgcccgttcgcatccggctggcgcactgggcgcgcgtttgctcaataatgtgcatcacctgatgcgccagggcgatgcaataccgcaggtgatgcttgccaccagcgtgatggatgccatgctggaacttagccgtaccgggctggggctggtggcggtttgcgatgagcaacatgttgtgaaaggcgtctttaccgacggcgacctgcgtcgctggctggtgggcggcggcgcgctcaccacgccggtaagcgaagccatgacgcccaacggtattacgctccaggcgcaaagccgcgccattgacgccaaagagctcctgatgaaacgcaaaattaccgccgcgccagtggtcgatgaaaacggcaaactcaccggcgccattaacctgcaggatttctaccaggcggggattatctaatccttcagtcccagacgcttcgccagccgatgcaggttggcgacgtcggtttccagcgcccgcgcgctggccgcccagttatgattattttgcgccagcgcctggcgaatcatctctcgctggaagttctccgtcgattcgcgcaaattgcggcaagtcggcagcgccagaaagctttccgcaggcggcgcgggtaaaacgtcctctgacaaggcaaaatgctgtgcctccagtatcacctcatcccctgcccgggtcgctctcgccagtacaaccgcacggtgaatggcatgttccagctcccggacgttgcccggccagccatagttgagcaaatggcgacgtgcgccgggactcagtaccacgcgggacagccccagccgcagtcggcactgctcgcaaaaatagcccgccagcagcaccacatcatcgccgcgctcgcgcagcggcggcacaaagagcgggaaaacgctcaggcgatggaacagatcggcgcgaaaacgccctgccagcacctcttcacgcaggtcacggttggtcgccgccaacacccgcacgtccacgcgcaggctacgatcgtcgccgacgcgctgaatatcgccatactgcaacacgcgaagtagcttagcctgtagcgccagcgacagttcgccaatctcatccagaaacagcgtaccgttatccgccatttcgaacttaccgctacgattactgatagccccggtaaaagccccttttacatgaccaaacaactcgctctccgccacgctttccggcagcgcggcgcagttgagatagaccagcggattaaccgctctgggggagccctggtgaatagctttcgccaccagctctttaccggtccccgtttcaccgccgatcagcacgttaagatcggagcccgccacaatctcgatctcttttttcaactgcgtcatcgccggcgacaggccgatcatgtgcgtctcttttatcggttcaaacacgcctgacgaccccggcagcatgttctggctttccagttgttcaattaacagcgcattactcaatgccccggcggccagcgcggcgacaagccgtagttcttcatcgctaaatacctcgaactgctccggcgtcatagcatcaagggtcagcgcaccgatgaggttctgtccggcaaacagcggcagaccaacacaggcgtggactttcaggctttcctgtccgggaattaacccgtcatacggatcgggtaaatcgctatcagccggaaaacgcaccacgtcccccgcgcgggcgatggcttccaggcgcggatgcccttccagggtaaaacgtctgccgaggacgtcctgcgccaggccatcaatcgccagtggaataaattgtcgtgattcatagcgcagcagcgccgaggcgtcgcacgccagcacctgacgcagcgtagtaatcagccgctgaaaacgatcctgatgcccaatgccgcgttgtaactcaatggcgatgcccgccaatacctccacggaaaaactcatggttacctcattgtcattttgacaacctatagtgtcatattgacagcatcatttatagtctttttgactacatcaaaaatacaaaacaaatataactcaatacaaatcaataagatgaaaagttggcacactagctgcaataagcaaaacaactttttgtaaacgttgaatgaattgaggtggttatgtctattctggttaaaaataatattcattgggttggccagcgcgactgggaagtacgtgattttcacggcactgaatacaaaacgctgcgcggcagcagctataacagctatctcattcgtgaagaaaagaatgtgctgatcgataccgtcgatcataagtttagccgtgagtttgtgcaaaacctgcgcagtgaaatcgacctcgcggatatcgactacatcatcattaaccatgccgaagaagaccatgcaggcgcgctgaccgaactgatggcgcagatcccggacacgcctatctactgtaccgccaacgccattgactctatcaacggccatcaccatcacccggaatggaattttaaggtggtgaaaaccggcgatacgctggatatcggcaacggcaagcagttgatcttcgtggaaacgccgatgctgcactggccggacagcatgatgacctatatgaccggcgacgcggtgttattcagcaacgacgcctttggtcagcactactgcgacgagcgcctgttcaatgatgaagtggaccaaactgaactgtttgaacaatgccagcgctactacgccaatatcctgacgccgttcagccgtctggtaacgccaaaaattaccgaaatcctcggcttcaacctgccggtggatatgattgccacctcacacggcgtggtatggcgcgacaacccaacgcaaatcgtggaactgtatctgaaatgggcgacagattatcaggaagatcgtatcactattttctacgataccatgtcgaacaatactcgcatgatggcggatgccatcgcgcagggtatcaacgaagtggaccccaacgtggcggtcaaaatctttaacgtcgcccgcagcgataaaaatgaaatattgaccaacgtcttccgttcgaaaggcgtgctggtcggcacttctaccatgaacaacgtgatgatgccgaaaatcgctggtctggtggaagagatgaccggcctgcgctttcgcaacaaacgcgccagcgccttcggttctcatggctggagcggcggcgcggtggatcgactgtccacgcgcttacaggatgccggttttgaaatgtccctgagtctgaaagcgaaatggcgtccggatctggatgcgctggagttgtgccgtcagcacggtcgcgacatcgcgcgtcagtgggcgcttgctccgctgccggaaaccacacagcaaatcgcgccagtcgaagaaaccataacctgcaccgccgcagacctcggccccaaaatgcaatgcagcgtatgccagtggatttacgaccctgcgctgggcgagccgttgcaggatgtcgcgccgggtacgccgtggaacgacgtgccggataacttcctgtgcccggaatgttcattaggtaaagacgtgttcgacgtactggcgacggaggcaaaatgagtcgggggatcatcattattgggtcgggcttcgccgcccgtcagctcgtcaaaaatattcgtaaacaagatgcgcatgtgccgttaaccctgattgcggcggacagcatggatgagtacaacaagcccgatctcagccacgttatcagccagtcgcagcgcgccgatgatctcacccgccagttagcgggggaatttgctgaacagtttaatctgcgacggttcccgcatacctgggttgctgacattgatgccgatgcccatgtggtgaaaagtcaggataagcagtggcagtacgacaagctggtactggcgaccggagcgacagcctttgtgccgccgattgcaggacgtgagttaatgcttactttgaatagccagcaggagtaccgcgcctgtgagacacaactgcgcgacgcgcagcgagtgctgattgtcggcggcggtctcattggcagtgaattagcgatggatttctgccgcgccgggaaaacggtaacgctgatggataacgccgccagccttctcgcctcactgatgccaccggaagtgagcagtcgcttacagcatcacctgaccgatatgggggtgcatctgctgctgaaatcgcagttgcaaaaactggagaaaaccgaagccggtatccgcgctacgctggtaagccagcatagtattgaggtcgatgcggtgattgccgccaccggcttacgcccggaaaccgctctggcgcgccgcgccggagtagccgtcaaccgcggcgtctgcgtggatagctatctacagaccagtcacccggatatttatgcgatcggcgattgcgcggagatcaacggtcaggtgctgcccttcctgcaaccgatccagttaagcgcgatgtacctggcgaaaaatctgctcggcggcaacgcgccgctgaagctaccggcgatgctggtcaaagtcaaaacgccggaactgccgctgcatctggcgggagaaactcagcgccgcgatttgagctggcatattaccgcagaatctgacggtatgattgccaaaggcatgagcggagaaggccaactacgcgcctttgtggtgagtgaagaccgcatgaaagaggcctttgcactgctaaaaacgttgtcggtataagcctgtgatgccggatggcgccgcttcgcgtcttatccggcctacgagtgagcatctgtttacaggccggataaggcgcagccgccatccgtcgccctacacttcacttaacgctcgcgctgcggcaatcacgccctgtccaaacgacagcccgccgtcgcccgctggtaaccgctgcggaaataacaatttaaaatcagaaagataaaaggcaagacgcgcgcgaagtaagcggttgtgtatcaccccgccgctgaagaccagagtggttatcccccgcgccgtagcctgctggcgcattagcgtggcaaacccgcacgccagcgcatcatgaaaagcccaggcgcgttgcgcaggcgtggcctgccagttcaaccattgccgccagaaaacggcgacgtccagttgagcgccgttaagcggcatcgttaccggatgctcaacgttagcgcattgagaggccagcgcctccagcgcgcaggcggcctcgccctcatagctaagcgatgctggcgcgcagcgaagcgcggcagccaccgcgtcaaacaaccgcccgcaggaagaggccaacggggcattgacgccgcgctcaatggcgcgcgccaggacattccagttttgctgttgcagccccgctgtctccgggtaatcctgccagtccggcacaaagcgcaggcactgcgccaacagattacgccacggatgtttggcagccagatcgcctcccggcagcgccacggcgggtaaaccacctaaatgttcgcattcgcgataattgacccgcaaacattctccgccccatagcgcgccattctcacccatgccgataccgtctaccgtcagggcaatcacctctccgccgtccagcggccaaccatgctcggccaggcaagccgccgcatgggcatgatggtgtaacaccgtctctgtcggcagacgcatctcactggcccactgactggaaacatagcccggatgcgcatcacagacgatacgctctggcgtaaaatcgtagattgactggatcagacgcaatgcctcgcgccactgcgcctggataccgtcatcgctgagatcgcctaaatgttggctgacaaccgcctgtgcgccgcgtaccagacagaacgtgtttttcagatccgcgcccagacaaagtatcggcggcacatcgcgaaatccgggcggcaacgcaatcgcgtccggcacgtatccccgcgaacgacgcagcatttcgccgctgtcgcgtacgacagagtcgtccatgcgctgtacaatgtcgcgattgtgcaacagaaaaccatcggcaatatcgtgtaaatcgtccagcgcctgttcgttggtgatggcgggcggtttgccgctcaggttgccggatgtcatcaccagcgggtaattgagctcctgcaacaagaggtgttgcaatgggttggctggcagcatcacacccacctccgtaagtcctggcgcgatgccctcactcagcgaaggtacatactgcttatccaccagtacaatcggggccgctggcgtggtcagcagcgaacgcgccgcgctcggcagcgtttgcgccgtgggcaacatcaccgccaatggtttcgccggacgatgtttacgcgcccgcagcatcgccactgcgttagcgttgcgcgcatcgcaggccagatgaaaaccacccagccctttaacggcaataatgcctccggcgttcagttgggcgaccgccgcctgcaaagccgcctctttttccgctcgttcatgttggctccgccactcaagatgcggcccgcatgacggacaggcaacgggctgggcatgaaaacggcgatcgtacggatcgcggtattcgctgtcgcattccggacacaagggaaacgccgccatcaccgtaaatggccggtcatagggcatagcgcgaataatggtgaagcgtggtccgcagtgggtgcaattgatgaaaggataacggtagcgccgctcgcctggggtattcatctcggcaagacatgccgggcaggtcgccgcatccggcacgatttgcgtgttcatcgaaccgcctgcgctctgacgaatggtgaaatccgtcggcgcgcgctcccataccaacgacgcgtgttcaacgctgtcaatgcgcgccagcggcgggcaatcctgatagagcgcggcaataaattgcgacggctcttccagcagccgaacgacgacgccgtcgccgtcattacacacgtcgccgtgtaatcgcaactgctgcgccagctgccagacaaaaggacgaaaaccgacgccctgtactttgccccgaatgcgtagctgtacgccggaaggtgtgtctatcgccatcttattttcccgccatcatcgaacccggatgcctgatggcgcgacgcttatcaggcctacaaccgcacggaccgtagaccggataaggcattgatgccgccatccggcaatgctttgtggcgtattctacgcgcaatcgcagaaatcagaaaagcagcgatgccgttgaatccagcgccgcgcgacggcgtttttccgcgctcagctgttcaagcttattgcggtccacgcagattagggcgtgcgttgggcaagcggccatacaggccggaccggcttcacggtggtgacacagatcgcacttgttggcttcggctttttcggcacgcacgttcagccccgcgccgctattgcgaaccaccggacgtaccaccacttccatggcgccgtaaggacatgccactacgcaagttttacagccaatgcagcgttcctgcatcacatgaacaaagcctttgtcacggctgatggcgccattcgggcaaacgttggcgcacggcgcgtcttcacactggcgacacagcgttgccgtggaaacgttcacgcctttgatgacatggatacgaggtaaaaaggtttcaggggtcagcgatgcgcaatcctgattttcctgatgggatacgacgcaagccacttcacaggtacggcaaccaatgcacttactcgcgtctgcaatgatgaaacggttcatcaaattctccagcaataacagatgatgtgccgatatatacacgaatcgtgccaatttttatttcattgttatttaagaatattatttctattttcgtgagcatttacgtgtcatcgtcacaagtgtcgatgacacgtaatgtcgccagtggtggtcaagatttgcagtgatagccagccaactctgcaccgcaactggcatcaatcctgattaacgcctggcaatacgttaccgcgtattaaacagcgctgcgtaagggaaagatcgtccgtttgcggattccttccggcaataggtttgataattaatttacgaccaggatagtgattaaaacgggtcagcgccggataactcaaccggccaaaccagccgtgtacgcgctgccagcgggcgtccttcacctgatataaattggttatccagtagcctgagtcaaattgcatatccaacagttgcgtgcgcccattgccctgtaaatcaagcaaatcatcaacgccagtatcggtcgcggtataaaacccccacggttcaaagacgcaggggcggccattcttgagaaaggtgaaaatgatgtattgcgcgctcggcgccaggcccaacccaggattgcccaaccagataaccagatcctgaatgccgttacgatcgaggtcagcgcgataaaattgcgcattacccgccaaattaatcagccttccaaccgggacaacccacgaattaccggctctgtcttttccgctaatccgccattcgttatcttttttcggctccggcagtagcgtcacgccactgactccgacctggcgaaagtgccaggtctggtcgggcgatacagaataaggcagggtcaacagcggcttcagcgcacgcttttgcgcatattcaccgtcgctcatcggcaggtaaccgacaacaccggtggccagtgcgcgtgcggcgaggcagagaaatagcagtccgctccatacgataatcttcacgtccttcttacaacctttgccgtgtaacacaaattctccctaaatatgtgcgcattttacgcctccggcgcttccagcgcggcaaatccgccgtttccctgccagccttccaggcgctgatagacgatgtttaccgcgtccttaatcggttgagtcatcggataataaaacccgacgatatccggctggataccaacaaaaatcacctccccgacatcctctttcagctgatcgataaggtagttgagcggcatattgtgggtggtcatcataaacatttcggcgatatcatccggatcgatgatgcggatctcgcccggattaagtcccatatcggtggcgtcgacaatcaacagacgctgcgggcgcagttcgcgaatcgccacaatgtcgttttccggcgcgctgccgccatcgatgacaacccagttgcccttcggctgcgccgcgcacatttccgccagtaacgggcctgcgccgtcgtcgcccatcatgctgttgccgacacagagtaaaacgtcagtcacgaagcctcctcaccatcagatagatggcgctttcctgatgaatgtcatacagcatactgagcatcagtttgctccattcttgctgctgcggggtctgcgcggcgcgcgcctcatcaaacgcgcgcgccagcatttgaacatggttgaaatcgatgacgatctcgccatacttcggcacgccttccattttacgccgggcatcgctaccggcttccagggtggcgatccacgccagatactcatcccatgggcaggtgagtgcggcctccagacaatcgataacccccaggtggtgaccaatcgccaggctgtaatagacaacctgctgcgcctcggcaggcgtcgcatcgttctcatcaataaacttacggctcagttgactgaacaccacctgttcgctcatcggatacgcgcctcttcaacaacatgattgagatgggtgacaatttcggttaaacgcggatcgttttccgcttccagccaacgcgccacttgctgctcgccctgccccaactgtgtcaggtaatcatcggcgatctgacgaccatagcgataacccgccagccggcgcgccgcgcgatccaccttcacgcgcagcggctgcaccatatccggatgcaggatctctgcgggctgatcgtccagctcacccggcgcgcgggcgtggattttctgctccagcaggccaagcgccattgcaaatccgtacagcgtggcggcaggcgttggcgggcaccccggaatgtacacatccaccgggacgattttgtcggtaccgccccagacgcagtagagatcatggaagatgccgccgctgttgccgcaggcgccgtaagagatacaaattttcgggtccggcgccgactgccaggcgcgcagcgccggagagcgcatggcgcgggtcaccgcgccggtaaacagcagaatatcggcatgacgcggcgacggtactactttgatgccgaaacgctcggcatcaaacagcggcgaaagcgtcgcaaagatttcgatttcacagccgttacagccgccgcagtccacgcggtaaacgtatgccgaacgcttaatatttttcagtaaagacgccttcatgctggcgatggattcatccaccgtcatcggtaccggaatgccgttggcgtcacgcgggcctaataaattgctcattagctgacctctttcatatggcgagtcagttcaatacggtcggacggcaccaggcatttctgacgcttacagtccgggcaggtctcaaagctttcgcggtggttttccgcgcggctgtcgccgttgtgcgcaagcagcgcaatggcgtagtcgatctctttctgtaccgcgaaaggacgattgcacacgcggcagttgcacagcgcaaagcgggactgttgcaggaaatcttctttcttccacaccgccagttcgtactcttgcgacagtttaatcgccgccgtcgggcacacctcttcgcagcgaccgcagaagatacaacggccaagattgaactgccacgccagctcattggtcgcgagatcggtttccaccgtcagcgcgttcgacgggcaggcattaacgcaggcggcgcagccgatgcactgctgcggattatgttccggcttgccgcggaagtttttatcaaccgcaatcggctccagcggataagacgaggtcgccgtgccggttttgataacttttttgataaaggtaaacatggcgattccttatttcagcggcgagtttttacgctcaatgctgtagcgctcaagttctttgtacggcacgactttgctcttcttcttacgcacatcgaccacggtcatccggtcggtacaggagtagcacgggtcgaggctgccgataatcagcggcgcgtcggagacggtgttgccgcgcagcatatagcgcagcgtcggccagttggcgtaggtcgccgcacggcagcgccagcggtacagcttctggttgtcgccggtcatgctccagtggatatcgtcaccacgcggcgcttcagcgaagccgagcgcaaaacggtgcggaatataggtaaagccttccaccatcagcgggccgcccggcagattatccagaccgaaatcgatcatattcagcgaggtgtaaacttcgttgatacggactttcagacgagaaatcacatcgcagccctgctcgctgtgcacttccatcggcagcaggccatagcccacaaacgggtggtcggcgcgggtgtcgcgggcgtgaccgctggcgcgcaccatcgggccgacattactgaagtcacgggcaatttccgggtccagacggccgatacccacggtacgctgttccatattcggcgtgctcagcagcatgtccaccagctcctgcacgtcacgacgcatctgctgcgccagttgacgggtctggatcatgtcctctttgagcagatcgcggcgaatcccgccgatcaggttcagtccgtaagttttgcgcgcgccggtaaggatctctgccattttcatggaggtttcacgcacgcggaagaactgcataaagccggagtcaaaaccggtaaagtggcaggcgaggcctaggttcagcaggtgcgagtgcagacgctccacttccagcagaatggcgcggatcatctgcgcacgctccggcacctgaatgcccatcgcgttttccacggaagtggtgtaggcagtgctgtgcgcgaagccgcagataccacacacgcgatccgacaggaaggtgacttcgttataacccatgcgggtttccgccagtttttccataccacggtggacgtagaacaggcggtagtcggcgtcgataatgttttcgccatcgacgaacagacggaagtggcccggttcatcggaggtgacatgcagcgggccaatcggcaccacgttatttttcttgtcacccagctcgttaatgaactcgtaggtttccgcatcggtggtcggcgccgggcgctgacgataatccatactgtctttacgcagcggatagagttcatccggccagtcgtccggcagcaccagacggcgctcgtccggcagaccgaccgggattaaaccgtacatgtcgcgtacttcgcgctcaccccacacggcagccggcacgcgcggcgtaacggatgggaattccagcttattggcatccacttcaacgcgaacggtaatccagcacttcgtgccctgctccatcgacagcacgtaataaacggcatagtggccgcacaactggcgttcgtcattaccgaacagcaccgacagccacccaccctgctggtagtaaagaaactccaccacttccggcagatagtttactttcaccgtaatagtcagctgatctttggtctgccaggcttcgtccagcacgacgcccggaaacgcctggtgcagcgccgcaaggtattgttgacctaatttttcttcagacatgctcaaactctcttaaatcacgccgccagcaaggagacgaaggctaaaaacgcaaacccaaaaccggcccaggtcacgcgtgaagtggcgcaaaaacgcagtcgcgccatgctgttttcaaacagggcgatcaccagtacgccaacaatcagcttgacgacggcaatcaccagcgccagcagcagtccgcctgcgctgaaggtttccatctgtccccacggcagaaacacgccgacgaacatttgcaacaccaccagttgtttaaggctgatgccccatttcaacaccgcaaagccgctaccgctgtattcggtcaacggcccttcctgcaactcctgctccgcttccgccaggtcgaacggcagcttgcccatttcgataaaggtggcgaaggcgcaggcgcacagcgccagaatcagcggaatactgcgcgcgacaggccagtgataaatggtatcggcgatattgctgatatgagttgaacccgccacctgcgcggcgacccacagacccagcagcagaatcggctccaccagcacgccgagcatcgcttcacggctggcgccgatcgcggtgaacgggctgccggtatccaggcctgcaatagagaagaagaagcgcgcgatggcgaacaggtaaatcagggtgattaaatcacccagttgcggcaacggagatccaacggtgacgaccggcagcgcggtggcgatagtcagcatcacgccgaccatcacaaacggcgtcaggcgaaaaacccagccagaatcagcgggcgcaatactctgacgaccgagcagtttgataatgtcgcggtactcctgcaacacgcccggccctcggcgattgtgtagacgggcgcgcaccacgcgagtaataccggacagcaatggcgcaacggcaaatagcaccagcgcctgaattaacggataaaacacactcattttcaggctcctcgtgaaaccacaatcaccaccagcaccgccagctcaatcagcgccagacgacggaacagcaccgcggccgccgcgttctgccagcccggaatcaacgataccgggttgagccacttacgcagtttgagtaccggggcaaaggcctctttcaccggcatggcaaaaccgtgcgcggtaatcaccatcgactgctcatggtcgtagccgcacacccaggccgcgccgcgagaacgcgacggcagacggttgcctttgaacatcgccataatgatgaacggcagtagcggacaggcgaccaacagcagcgtgatcatcggctgcgatacggtggtgtgcgcggtttccagcggcaacggtaccgcagtggaaatcatcggcaacagccacggcgcggcaaccccgcccagtacacagcaaatcgccaatgccaccacgctgacgcccatcaggatcggcgcgcagctggcattttcagcttccttcgtgcgcggcgcgccaaggaacgtcacgccatacactttcgccatacacatcaccgccagcgcgccggtaatcgccaggccaaccgccagcagcggtcctaacagacgaccaacaaacgcaccgctgttgcccagtttgaagaaggactgataaatcacccactcgccggcaaagccgttcagcggcggcagcgccgccatcgccatcagaccgaccagcatggcgatagaaataaccggcatccgtttaccaataccgcccagtttttcgatatcgcgatgaccggtacggaaccagatgctgcccgcgcccagaaacagcacgcttttgaacaggctatggttcagcaggtgatagagcccgccggtcagacccagcgcgatcagtaccggctgattgagagcaatcccggtaacgcctgcgcccagaccgagcaaaatgatgccgatattttccagcgtgtgataggccaacaggcgctgaatgttatgctccatcagcgcgtacagaccgccgacaaaggcggtgatcatccctagcaccaacagcgccacgccccaccacagcggcgcattgccgccaagcagagatagcgtgaggatacccagcaacccgattttcatcaccacggtcgagaacagcgcggcggcgggagcgctggcgttggcgtgcgcctgcggcacccaaccgtgtagcgggataatcccggccagcagaccaaaaccgataacgccgagcagccagatatcggagcccagcggcagttgctgagcgcgttgatccagcagccccagatccagcgtgccgtagcgctgccacaccagccaacaggcgattgccagcagcagcgtaccgagacggcccagcgcaaaccacagtttgccctctttgctaccgccggtgaggaacacggcgcagagcgccatgatttccgccatcaccaccatcgtccccagattactggcgaccacggcgcagacggctgccgccatcagcaggttgattaacagcccgttggcttttacctgtggatggcgatgccagtcgatattgaacaggctgacgaacagaccgcacagccccagcgtaatcagccagatagcattcagcggcgtaatttgcagcatgtggccggtaaacggcatcacgccgctaaccgtaacggcgctggtcagcgcggtgaaccccgcgcctgccgtacacaggctgccgaccgcgccgccgataccggcaatccagccgctcagcgctttatgaaacgaaaacagaaacgccagaacggcggcggcggcaaaccacgcgacgccgctagtaatcagtgaaagtgaactcattatgcatccccactctgagcctgctgaaacaaggtgagatcgccaaaatcggtattaaacgtcagctcacgtttacgtttgctggcgcgggcgatatccgtgttctccaccaggtgtagcgctttagtcgggcacatccgcacacaggccgggccttgctcgtcaaagctgcacaggtcgcatttcaccgcgatagcgcgtacgcccggcacccagtcgagcaacgtactgacgcgcgcaggcgctggcggcgcgggcggcgctttcggcgtattggcgttcgccggaatatgcagcggacggctgccggaaaactcaatagcgccaaacggacaggcaataccacacagtttgcagctcacgcacaggctttcattaagctggacagcgccgtcaacgcgattaatcgcgttaaccgggcataccgtggcgcatggcgcatcttcacagtggtgacaaagctgcggcgcagattctttttcattcagcatcactttcaggcgcggcattgactgcaggccatgctggcgatgcgtctctgaacaggcggcctcacaggtgtggcagccgatacagagagtggagtcagcaattacaaaacgattcaccaggcattcctcaggtgattgtcatttttgacgaaaacatgccgttgaaatgtcattttcgacacttatcgacacgcccatccccaaaacattcatgacatggcgcaacgccacatcgcgaatcaaagcgggcaacgcctcaggcttataccgccgggctgtgtccctttaccaattgacgcaaattaaccggcgagttggtttctacagcggtatagaggctgtcgtaaacgctggcgattttttccagatagtgctccagcacctgctcgcgatcgcggttgttaacccgttcatcaaccttgccgtcgatatcgagctgcgcctgtgcaatcaattgtttatcttcgccatctttggtttcaacgtagtactcaatggtgtggctgttaaaaccatccgccaacgcgacgtaaatacgaaagtgctcaaacaggacaaagcaaagatccctttccggcgcgcagctcattgcgtgatgcaggcgcgctttcgagagggtgatcccctgaaccagcgagttgcagtaaatatgccactggtcctgtaggcgacgatgccgttgcgcgatgtaatcggccttttcgcttatttcccaaatagtcatgtcaggttacccgtttaacagagatgcctgcgttaagcattttccatgccaatttttaacttattgtttttaatggcagacgcgcacagttactgccgtttcgacgcggtgacgacatgtcatttcgtcatcgtcgacattaacctgccaggggataaaaatattggcataaatattgctttacaggggcaaccactacgggaggcgatatgcacgaaatcaccctctgccaacgggcactggaattgattgaacaacaggcttcagcatacggtgcaaaacgtgtgacagccgtctggatcaaaattggcgcattttcttgcgtggaaaccagcgctctttccttttgttttgatctggtatgccgcggcacgatagcagaaggttgtaaactgcacctcgaagaacaggaagccgaatgctggtgtgagcattgtcaacaatatgtcacgttgttaacccaccgtgtacgtcgttgtccgcaatgtcatagcgatacgctgcgaattgtggccgatgacggcttacaaattcggcgcatagagattgatgaaactgaagattaatgccggatagacgctcgcgtcgccatccggcagaaagcctgtaacaagaaaaagatcaggagtaagcgatgtgtacgacttgcggttgcgctgaaggcaacctttatatagaaggcgatgaacataatccgcactcagcgtttcgtagcgcgccctttgccccagcggctcgcccggcgctgaatattaccggcattaaaacgcctgactttgccccaagtcagaccgcagaaggcgatctgcattacggccacggcgaagccggaacccacgcgcctggtatgagtcagcggcggatgcttgaggttgaaatcgacgtgctggacaaaaataatcgtctggctgagcgcaaccgcgcccgtttcgccgcccgccagcaactggtgctcaacctggtgtccagccccgggtccggtaaaaccaccttgctgactgaaacgctgatgaaattgaaagaccgtgtaccgtgcgcggtgattgaaggcgaccagcagacagtgaacgacgccgcccgcatccgcgctaccggcacgcccgccattcaggtcaacaccggtaaaggctgccatcttgacgcgcaaatgatcgccgacgccgcgccgcgcctgccgctggatgaccatggtattctgtttatcgaaaacgtcggtaatcttgtctgcccggccagcttcgatctgggcgaaaagcataaagtcgcagtgctttccgtgaccgaaggtgaagataagccgctgaaatatccccatatgtttgccgctgcgtcgctcatgctgctcaataaagtcgatctgctgccctacctcaattttgacgttgagaagtgcatcgccagcgcgcgtgaagtgaacccggagattgaaattatcctgatttccgccaccagcggcgaaggcatggatcagtggctggcctggctggaggcgcagcgatgtgcataggcgttccgggtcaaatccgcgccattgacggcaatcaggcaaaagttgacgtctgcggcattcagcgcgacgtcgatctcacattagtcggcagttgtgatgaaaacggtcagccgcgtctgggtcagtgggtgctggtccatgtcggattcgccatgagcgtcattaacgaagcggaagcgcgcgacacgctcgacgcgctacaaaatatgtttgatgttgagccggacgtcggcgcactgctgtatggtgaggagagataatgcgttttgttgacgagtaccgtgcgccggaacaggtaatgcagctcattgaacacctgcgtgaacgcgccgcccttcttccttacactgccgaacgaccgctgcgcattatggaagtctgcgggggtcatacccacgcgatttttaaatttggtctcgatcagttactgcccgaaaacgtggagtttattcacggccccggttgtccggtctgcgtgctgccaatgggacgcatcgacagttgcgtggaaatcgccagccatccggaggtgattttctgcacctttggcgatgccatgcgcgtgccggggaaacagggttctctgttgcaggctaaagcgcgcggcgcggatgtgcgtattgtttattctccgatggacgcgctgaagctggcgcaggataacccgacccgcaaagtggtatttttcgggctgggctttgaaaccaccatgccgaccaccgccatcacgctgcagcaggcaaaacagcgtgacgtgcgaaacttctactttttttgccagcacattacgctgatcccgacgctgcgtagcctactggagcagccggacaacggcattgacgcctttcttgcgccaggccacgtcagcatggtcatcggcaccgaggcgtaccagtttatcgccgccgattttcatcgcccgctggtggtggctggattcgaaccgcttgatctactgcaaggcgtggtcatgctggttgagcagaaaatagcggccctaagccaggttgaaaatcaataccgtcgcgtggtgccggatgccggaaacatgctggcgcagcaggccattgccgatgtgttctgcgttaatggcgatagcgagtggcgcggtctgggcgtgattgaatcctccggcgtccacctgacgccggagtatcagcgctttgacgccgaagcgcatttccgcccagcgccgcagcaggtctatgacgatccgcgcgcccgctgcggcgaagtgctgaccggcagatgcaagccgcatcagtgcccgctatttggtaaaacatgtaatccagagaccgcgttcggcgcgctgatggtctcttccgaaggcgcatgcgccgcctggtatcagtatcgtcagcaggagtgtgaagtttgaacaatatacaactcgcccacggcagcggcggccaggctatgcaacagttgattaatagcctgtttatggaggcctttgccaacccgtggctggcggaacaagaagatcaggcgcgtctggagctggcgcagctgacggcggagggcgaccgtctggcgttttctaccgatagctatgtgatcgatccgctctttttccccggcggcaatatcggcaaactggcgatttgcggtacggcgaacgacgttgcggtgagcggcgcgatcccccgctatctctcctgcggctttatccttgaagaagggctgccgatggagacgttaaaaagcgtggtcaatagcatggcggcgaccgcgcgggaagcggatatcgccattgtaaccggcgacaccaaagttgtgcagcgcggcgcggcggataaattatttatcaacactgccggcatgggggcgattcccgccgatattcgctggggcgcgcaaacgctgagcgttggcgatgtgctgttagtcagcggtacgcttggcgatcacggcgccactatcctcaacctgcgtgagcaactgggactggatggcgagctggcgagcgactgcgcagtattaacgccgcttattcagacgctgcgtcatattgacggagtgaaggcattgcgtgacgccacgcgcggcggcgtgaatgcggtcgcccatgagtttgcggcgtcctgcggttacggtattgaattgtccgaatccgcactgccgctcaaacctgccgtgcgcggcgtctgcgagctgttggggctggatgccctgaactttgccaacgaaggaaaactggtgattgccgttgaacggcaggccgcagatcgggcgttggcggcattacgcgcgcatccgctgggacgtgatgcggcgctgattggcgaagtcgtggaacgcaaaggcgttcgcttagccggactctatggcgtgaagcgaacccttgatttgccacacgccgaaccattacctcgtatatgctagcagcctgttgacagcatactgtaagccggataagacgcatttgcgtcgacatccggcattaacgctgcatgaacgcctgatggcgctttgcttatcaggcctacggagtgtgtgaccagcgagtttgcggtcagccatccggcaataacttacgacttatacctataattcatttaccgttttcgcaccgttttgcggtattttcctggaaaagcaacatgtcgtatacacccatgagcgatcttggacagcaaggcttgttcgatatcactcgtaccttattgcagcagcccgatttggcgtcgctcagtgaagcgctttcgcaactggtaaagcgttcagcgctcgccgacagcgccggcattgtgctatggcaggcgcagtcgcaacgcgcacaatattatgcgacgcgagaaaatggccgtcctgttgaatatgaagatgaaaccgtactggcgcacggcccggtacgtcgcatcctttctcgccccgatgcattgcactgtaatttccatgagtttaccgaaacctggccgcagcttgccgcgagcggcctctaccctgaatttggtcattactgtctgcttcctttagccgcggagggccgtattttcggcggctgcgaattcatccgtcaggaagatcgcccctggagtgaaaaggaatatgaccgtctgcatacgtttacccaaattgtcggcgtggtcgccgagcaaattcaaaaccgggtaaacaataacgtcgattatgatctgttgtgccgcgaacgcgataacttccgtattctggttgcgattaccaacgccgtcctgtcgcgtctggatattgatgaactggtaagcgaagtcgcaaaagagattcaccactatttcaatatcgacgcgatcagcatcgtgttgcgcagccatcgcaaaaataagctgaatatctactccacccactaccttgatgagcatcatccggcgcacgaacagagcgaagtcgacgaagccggcacgctcacggagcgcgtctttaaaagtaaagagatgctgcttatcaacctcaacgaacgcgatccgcttgccccctacgaacgcatgctgttcgatacctggggcaatcagatccagacgctttgcctgctgccgttgatgtccggcaagacgatgcttggcgtgctcaaactggcccagtgcgaagaaaaagtgtttaccaccgccaacctcaagctgctgcgtcagattgccgaacgggtagccattgccgtggataatgcgctggcctatcaggaaatccaccgactgaaggaacgcctggtcgacgaaaacctggcgctcacggaacagcttaataacgtcgacagcgagtttggcgagatcatcggacgcagcgaagcgatgtacaacgtgctaaagcaggttgagatggtggcgcagagcgacagtaccgtgctgattctgggcgaaacgggaaccggtaaagagttgattgcccgcgccattcacaacctgagcggacgtagcgggcgcaggatggtaaagatgaactgcgccgcgatgccggcggggctgctggaaagcgatctgtttggtcatgagcgcggcgcgtttaccggcgccagcgcgcagcggattggccgtttcgagctggcggataaaagctcgctgtttctggatgaagtgggcgacatgccgctggagctacagcctaagctgctgcgcgtccttcaggagcaagagtttgaacgtctcggcagcaataaactgatccagaccgacgtgcggctgatcgccgcgactaaccgcgatctgaaaaaaatggtcgccgatcgcgaattccgtaacgatctctactatcggctgaatgtttttccgatccagcttcctccgttgcgcgaacgtccggaagatattccactactggtcaaagcgttcactttcaaaatcgcccgccgaatggggcgtaatatcgacagcattcccgccgaaacgctgcgcacgcttagcagcatggaatggccggggaacgttcgcgagctggagaatgtcgtcgagcgcgccgtgctgctgacgcgcggcaatgtgctacaactgtcgctgccggatattaccgccgtaacgcccgatacctcgcctgttgcgactgaaagcgacaaagaaggcgaagatgaatatcagcttattatacgcgtgctgaaagagaccaatggcgtagtggctggaccaaaaggcgcggcgcagcgtctggggcttaaacgaaccaccctgctgtcgcgtatgaagcgattgggtattgataaagacgcgttagcgtaacgggttgccggatctgatccggcctggagatgatgcgcgccgtaggcctggcgcttccccttcacttcttgcgctgatatttttccggcaattccggaacggggcgcttatcgtcgataaggtgccgcacggtcaggacaggatgccgccaaagcattcgcggacctgcccaacgcataatctgcttcatctcctcgcgtttagccggctgatagcagtgcaccgggcactgcttacaggcgggtttttcctcgccaaatacgcatttatcaagacgtttttgcgcgtaggcgaacagcgcgtcgtaatgcccctgcaccgttgacgcctgtgggcactggctttcatacagcgcgatcatttttttgatcgtcagtttttcacgagcgatacgtttaccaggcatcgtgctctctccgaacattaaggtgtatttattttacaccttatccctctttagcactatcactgcatattgtcgccatttcgcaaataagaattattttcatttatccataccttgtgctatataacatagcaaaggctatattcgatgattaattaaccacattgttgcgagggatactatgacgaatctacatcgtctgaaaacactcctgattgccggtattgtcgcgatactcgcgctatcgccagcctatgcaaaagagaaatttaaagttatcaccacgtttaccgttattgccgacatggcgaaaaacgtggcgggcgacgcagcggaagtcagctcgattaccaaacccggcgctgaaatccatgagtatcagccaacgcccggcgatattaaacgagcgcagggggcacagcttatcctcgcgaatggtctgaacctggagcgatggttcgcccgcttttatcagcacctttccggcgtgccggaagtcgtcgtctccaccggcgtcaaaccgatgggcattaccgaaggcccgtataacggtaaaccgaacccgcacgcctggatgtcggcagaaaacgcgctgatttatgtcgataacattcgcgacgccctggtgaagtacgatccggataatgcgcagatctataagcaaaatgccgaacgctataaagcgaaaattcgccagatggccgatccgttgcgtgccgaactggaaaaaattcccgccgatcagcgctggttggtcaccagtgaaggcgcgttctcttacctggcgcgcgataacgacatgaaagagctttatctctggccaattaacgccgatcaacaggggacgccaaaacaggtgcgtaaagtgattgataccattaaaaagcaccatattcccgccatctttagcgagagtacggtttccgataaaccggcccgtcaggtcgcgcgtgaatccggcgcgcattatggcggcgtgctgtatgtcgattctctgagcgccgctgacggccctgtgccaacctatctggatctgctgcgcgtcacgaccgaaaccatcgtcaacggcattaacgacggactgaggagtcaacaatgagtcaatctgcgattaccgttgatcaagtcacggtgacgtatcgcaacggtcataccgccctacgggacgccacttttcaggtgcctggcggttcaatcgccgcgctggtaggcgtaaatggttccggtaagtctacgttatttaaagcgttaatgggctttgtgcatcttgcgcagggcgatatcactatcctgcaacagtcagtcaacaaggcactgaaaaaaaacctcattgcttatgttccgcaatcggaagaagtggactggtcatttccggtgctggtagaagatgtggtgatgatgggacgctacggccatatgggctggctacgccgtcccactgcgcatgatcacgcctgtgttgacgccgcgctggcgcgggtggatatgcaggagtatcgtcacaggcagattggcgagctgtccggcgggcagaaaaaacgtgtgtttcttgccagggccatcgctcaggatggacaggtgatcctgctggatgaaccttttaccggcgtggatgtaaaaaccgaagcgcgaatcatcgatctactgcgggaactgcgcgatgaaggccgcacgatgctggtctcaacgcataatctcggctccgtcaccgagttttgcgactatacggtaatgattaaaggaaccgtactggccagcggccctaccgaaaccacgtttaccgccgcgaatctggaacaggcgtttagcggcgttctacgtcatatcgcgttaagcggaggtgaagagcacatcatcaccgatgacgagcgcccctttatttcccggcgcgtggccagcggaggaaaatcgtcatgaactggcttgttgagccgtttggctaccagtatatgctcaacgcgatgtgggtctccgcgatggtgggcggtctgtgcgcgtttctctcctgctatttgatgctcaaaggctggtcgctcattggcgatgcgctatctcactctattgtgcctggcgtcgctggcgcctggatgttagggctgcccttctcgctcggcgcgtttctttccggcggactggcggcaggcagtatgctctttcttaaccaacgctcacgcctgaaagaagacgcgattatcgggcttatcttctcctctttttttggcgtcggcctttttatggtgtcgctcaatccgatgtcggtgaatatccagacgattattctcggcaacgtgctggcgatcgcaccagcggatattgcgcaactggcgattatcggcgcagtctcgctgacgattctgctgttaaagtggaaagatctgatggtcgtctttttcgatgaaacccatgcgcgttctatcgggcttaatccgggtcgactaaagctgttgtttttcactctattgtccgtctctaccgtggcggccctgcaaaccgttggggcgttcctggtgatctgtctcgtcgtcacgccgggcgcgacggcctggttactcaccgaccgttttccacgtctgctcatgattgccgtcgtgattggcagcctgaccagttttctgggcgcatggcttagctactggctggatggcgccacgggtggaattattgtcgtcatgcaaaccttactgttcatcacagcctttattttcgccccgaaacacggtctgttagccaaccgtcgacgcgcccgcctgcagaaggagccgacatgttcttaacaacgttactggaaccctttcagtttgattttatggtgaacgcccttatggtttcggtcattgtggcgattccctgcgccttactgtccgtgtttttagtgttaaaaggctgggcgttaatgggcgatgcaatgagtcatgcggtattccccggggtcgtgctggcatatattgtggggatccccctggcgattggcgctttcattgccggattattttgcgctatcgccaccggctatctggacgataacagccgcatcaaacgtgatacggtgatgggcatcgtcttttccgggatgtttggcgcaggtctggtgctctatgtttctattcaatcggaagtgcatctggatcacatcctgtttggggatatgctgggcgtatcgctgggggatatcgtacaaacgtcagttattgcactgggtattgcgttaatcatagggctgaaatggaaagatctcctgctacacgcttttgacccgcaccaggcgaaagccagcgggctgaataccacactactgcattatggcctgctatgtatgattgcgctgactatcgtcgccacgctgaaatcggtgggcattattctgtcaatctcactgcttatcgcccccggcgcaattgccattttgctgacgcgacgctttgcgcgcgcgctgggattagcggtgagtctgtcagttattaccgcttttgcgggcgtttatctgtctttttatcttgatagcgcgccagcgccgaccatcgtggtattatttgccatcgtgtttattgcggcatttatttacgcaacatggcgcgacaggcgtaatgaaatcgtaccagaggcgcaaggttaacacttttttgcctgctattcaggaaacatacggtcataatatagagtagtcttatggcgctggaaggatttcctctggcaggcaaccttataatttcattacggtttaagtaaagacttatattcagctatcctttttttatgagcggatatagagagttttttatcgtttagcataacggcattgttatcgaatcgctcataaagcgtttcattctttttgtttactatactgcttcccgccgccggattggcctccacatattcatttaatcgttgtgcgccttgagtatgtttgtaaaaactcaccggcagatagcggtctgctttatcggacgggagaaaaggttcttcaccacacagacgttcacaaatattatcttcatgaatttttactaagttcataaattcaagctgaagttttttggcgagcgccaggctaaaaataccgcattcagaagagcttcgttgaatgtccagctcgaccatagcaaaataacaatcaggcagttgttcacgttcaagagctgctttggtcctcaacgccagtaaagcaggtccaaaagcgctacacgctgctggttcgaacaaaatcaccgatgtctttccgtccataactctaaaatcgacgactgaaatatggatacctgaacttcccatatttacgagaaatcgggcagattcaacgccttccattctggtctcctttatagaggaaacaagctcatggactgacataacaaatttaagatttaactctggatacttcttattggcctgtgcaacaagaaaaggcatcatttcgagatcggtttcctcgtaactgatatgaatccagctgccatctataatttcactttccagacgctcaacaatacaggtcaatgcttcggtgtttagctccccgctgacgtcaggctgaggcgataaactcgcccccatattacgagtcgtaggacttagcatacttttccctccacatgatagctcctgcaccgaaaatatcatctttaacttttcagatttaatatattgcctgcaaaaatatgcctcaatgattgagccaggctaccaaccacctccggatgattatatataagaattactactcaaaaaatcttttttataataaaagctcaacacatggtcataaatgataaaaaatattttaattcattcctaccgcaatcggtaacgcgcaattatcgtcaggtacagcagggttatgtgcaaaagcagtgcgctgtaaatgcgcgtctagtttcagtccccggaacagcgatagcggtgaagagtccatccccaaacgatacataaccttcttacgataaatactgacggtttttgttcccagaccaaattttttcgccagttcaattgccggatgtccggaggataataatatcagcagcgcatatttcgcctgcgtgacaccgggaggtagattccaccaggcgtattgattgatattaaacaatacctcttccggcgtctcgccggcattaaaagcatacgtagcagccacggttttcttttgtggcctgtggcagaaacgcagccaggcttccggaagacggagcttctctcgctccgagcggatagcgcaggatagttcgtcttttaaaacataatccataacgccaaaatattgcagcacacagcgatcgatataatacaagcgatctgccactaccaaaactttacggttctgcaaccgcgtcagcaacgcatgaaaaagataaacatgctcatgcgggttcaaagctaaaatcagcccggcgtccggcatatcggatagggaatgcaaaagtgcagttaatgagttacacgttttaacgcacttttccggatatttttgcttaaaaatagactgtagggcataacaattagtccagttaataccgtatataattacatttctcatttatttatccttttttgaaaactgaccacagcttcggtaatgatttttcttcctgggcgactactgcgcaagtagataacgccttcttactacaaaggtaataagaccagatacgttattacatgcgcaatgtcgttaccgaaatgaattccttttacaaatctgataatgattaaatttgctgttttactttactgtaatctcttagagtacaacgattgcccggcgcctggtggccatgtatgtctgacaatgaacgctttcgattccctttcattaactacatatcactggtgtagcgatactgaaatatacactacgattaaaaaaatatttggtatctgtaacgcaaacagatagtaacgtttaaaataatttcacaaatcaatggttcattgtacgcataaagctaagcggtgtaatcttaaaatgccgtttaaaaatagcgataaaataagaaggcgtatcatagccacacatcgtcgcgacttgtgaaatatttccagcccccatacgtaataattttatagcctgattcatacgagcatccaggtatattttactaaaactcacctcttcagcggccagttttcgcttcagacttgatacgctcataaacagctttcctgccacctcagcctgtgaccatttgcgggtgagatcgctgataataatgttataaactttctcttttgtcgtaatttttattgctcgctcaaggaaatcaaacccaccgggcttacgtacaaatgccgatataagatacatcaatgagaaatatgaataatcatgatcatcaatactcacattactacaaacccgtggacatgccacaccatgcaaaatagagtcaaaagtatcactcatccctggcaacaagtccgcatgaaaaaaatactttggtttcgtttttaatgatagctctcgatcattatagtttcttgtactgtaaaaaactttgtagaatttttgcattaagtcataggaaacttccagtgaagaaaaatcaatatgcccttctatttcgctcatactaagcgtgattgtttgatctttttccaataaaaataaacacggcgcagatcgttcgatgaactccccaaattcgttttcaattcgcaaactgcctttattaagtttaaacaataagcagtttgcgacataatagtctcttacgtcagctaatccatttattaatggaaatttgttcggctgttgaaggtgattattgctaatggcctcaactgatttattcattgaaggcaataccatattttatcctgtgtgctataaggaactcaaaatcgttatattcttataaacaaataattaaaactcacagagatgatttaaatccgatttttttattattatagccaataattacattccaacgcgcgttcatttcgtcacaaaaagatacccttacaaactttatgcacaattttgtaatgaaagcttacaatattaatataatcatttcagaataaaacggctggcagacatcttaataatccatatacatcaataagatagacacactggcatggtgcattttctgcattatttgctgatatatacaccataccttatcacaaatcgccagcaatgggggttcaccagtcaattgcctctttgttttccccgcccgataaaataatctcctgcatccaggaggtcatttgtgactgtgcgttcattgaaccaactaataccccgtttaaagcctcatataaatgggtgcccggttcaacttttgctaacatgttttgtagcatagccgtttgctgctcaaaagaaacaaaagccgaatcaccactgttaggatctttgaaggcattcatctcttgataaatgctatctttaagcgtttcagaagaggctgactcaggaagcgccaaaagtcgttggtagaatgcatcataaagatcaacgtcgccgccattgcttaaaggcgcgctatccatattattcagcatagcggccctggcactcaacgaaaccacacccgtcgcttcagtatctgctgtcgggaccaaataagaagtcggaatcgtacccggtatcaccttataacctccgcttgcgtttttgtcttccattcatcaataagtgcgttaatggcgttatcagaaattgtccggcagtcttgtggaagttcatcaagatgatgcttaatgacgcctactgccgtttcaacaaattgttcaggtgaaaattctgcgatctgatcgccgcaactcatgataaagcgctgttcctggtgatatttaagattaaaagtgcctggccagttctccataagcaacaccatcagtttttggtgatcttttttcgcattaactggcagtgttaaaaaaagttgcccctcaggcttatcgaaatcccttagccactcatccaggacggttaaaagcgtttcgggatggtcgaccgcagctgaaaataactcgcgggcataaatctgtattttttccatccacttccaggccattgtctgattatcagtaagataagcggcgacctgctgtaacgcgtctatcattccctgctcgtaaccttcctgataggcgtacatccgcaaggtctttgcctcttcttccgcctctcgcaaaatacgcttagcccgttgatgcgcctgctgttctaatctttcaatagagaaataacgttccagcgttttacgctttatcagtatcccctcaacaggcgaaagcggggacggtattgggatatttttgagcatattgtaaggccagtagcaaaattgacatttctacagcatcctgcttcaatgcctcctcaataaatggaggaaaaagcaaaggaaaacgctgtgctaaagattcaggtaaaaattcatttagggcatttaactgtgcatacccgacgctaagtaaaaaccggtgattcggcgccttattgcagacagataaacttgttccctgatgcattgccaaaaatgcttgcgcccaatccggcaggccaagcaaggctccctgccttgccagatcggctctcagtttatggcaaccgagtaaatacgctacttgcggcagtcggcgccactgacgcagccacagctgcgtcagtgagttttgaatacactccttttctccgttcttaagccgccatgccgccagtattaactcatttgccgccgccctggcggcgggtctgacaatcatttccggcgctatctgcaaccgctgaggatggatatacgataacggatcaaaaatgattctttgccagataatgggtaatggctgcctattcatttgacgatttcgccttatcatcagccgttatgcctttcttattgcgggcataatggtttttgtaataccagacgccaaagcctgctgacatcacggataacaaaataatcaaaacaatccaactggttgcaaaagaattacgttttactggtgtgccgggagcctgtaattgggcatcagaacgttctgacaacacaacagaaatgttgtcataatccacatcggcaaaactattctttaagaaacgcttgatatcgctgatctgatgcgcaagcggcgaacctcgttcatatacggctaatgccgacagatgaacaggttttggcgggcggccattttcaccagcatcaatatcataactaatatggaccctggcggagagcacgccctccatcgtctgtaatgactgttccagtcgctgttcaatagccgaatataacctggccttttcagctcgcggagacgataccagcgaatccgccgggaacatctgcgctatttccacccgtggccggggaggaagctgataagttttaatccagtacaccgcagcggtaaaatcaggctcagcaacggtaatgctatagcccaattttccgctatcaattttattcgcctctatattgtgcatttgcagaacggcaatgacctcattagcctgttcctggtccagtccttttaaaagatccttatccttacagccggcaagggtcattaccagcagaaaagtatatagatatcgacgaatcatgagcgtaatagcgtttcaacagccccgactcctttacgagtaagggtactgaccatagaaacatacaggttataatctgaaatcatctcttgcgaaatagccagctctttaggatccgtcaccagattagggtcctcaatcctgttggtaatcgtctgtttatccacagccgtggcaatcgccgaaccagaaaaagcctggagtagccggtcatccagcgagacaatgtccgtttccatagacctgatattgaccgcctgccctataacggcattctcagggacaatagttgcaatcgacataatccaccttataactgattaacggaagttctgaataatggcagcatcaatatccttaaagacttttaccgtgttcgattgcgcgttacggtacaagttatattccgagagcttactctgatacgccgccagtagcgccggatcggagggttttgctgctaatttatccagcgcctctgttacctgcgtttgtagattatcaacgcccgtatcaaattttgctgagacgtcatccagatagcctgaccaaggtgttgccataatgacttccttatttacgttaaattaaagtgggcttgggaaataccaatggcctgggctcattttgatataaccttccgccccgtactgaaatgagcgccccttgagccagtcatcttttaattcgatcgcaaactgcacatagcgtcctccccatgtgcggtaatagctatcgacaaattgacgggctctgagtatttctacatcatcgagcgccccctgaataacaaacgttacgccccccttatgattcctgcgggaataaggtaacgcctgctgttttagccccgcttccgcctggcctgctgcggtaacatcgtccatcaacgtgatgttaaccgaatccgcgtaaggcattagcgctctcagcttttgacttaacacctcgagctctttcttgctcatcgtgtttcgctggcggcttagccagaaaacgggtttacgcggctcatcgaaatgaatccgataataagccagctgcggataataggtatccagccagatagagatacgcttattttcttcgttttcgttaatcactcgcgcatttttatcataatcgcccctcgctaaaacctgacgagcccacaacgtatctctttcattttgcgcagcgacatagagcattttgtcccggcctggcaacacctgaaaacgctccttctcctgccccaataacgaatcgagctctgcggcctgccgctgcggcgagttaagtatccataacgtccccacagtcccaattcccaatataaaaaacccggccagtgctgctacaattccgtttttaaaacgcggctcgttcttttttgcagacgtttctaacttctcaggctgctcgggcacccacggctcgctttccgggcgaatcaggataagcaattcaccgacctgtattggcgtatttaattgcaccgaacgagattcagaatttccttctttcagctcatggagtataatttcggtcgcatccgtatccacctggatttcaaaatttactccgccatggtccagcgggataaaaaagctatcggcaggtatatcagggagttgacctgaagcagtgagcgcatcactctgacctaccacaaagagtgttcggcctgtcagcaatggaaactcacagccgttcagtgagctgttaagtaatcgaactatgtatggccctgggcttgttatcgtcttctcttttgatgtttccatatatactgttagcgatgtctgtcgttctcgatagcagcagattaccgcacaggacacagggattcctgatgaaaatagaatgaaaagtgagaaataaaatcaatttattctgtataatgcgtctcaacacatattaaaagaaccatcatccccattggggcttaaactactgtagataaattacccaaatttgggttcttttggtgtaacaatcagaccattgccaacacacgctaataaagagcatttacaactcagattttttcagtaggataccagtaaggaacattaaaataacatcaacaaagggataatatggaaaatgtaacctttgtaagtaatagtcatcagcgtcctgccgcagataacttacagaaattaaaatcacttttgacaaatacccggcagcaaattaaaagtcagactcagcaggttaccatcaaaaatctttatgtaagcagtttcactttagtttgctttcggagcggtaaactgacgattagcaataatcacgatacgatttactgtgacgaacctgggatgttggtgctcaaaaaagagcaggtagttaacgtgacgcttgaagaggtcaatggccacatggatttcgatatactcgagataccgacgcaacgacttggcgctctctatgcacttatcccaaacgagcagcaaaccaaaatggcggtacccacagagaaagcgcagaagatcttctatacgcctgactttcctgccagaagagaggtatttgaacatctgaaaacggcgttctcctgtacgaaggatacaagcaaaggttgcagtaactgtaacaacaaaagttgtattgaaaatgaagagttaattccttattttctgctgttcctgcttactgcttttctccgactcccggagagttatgagatcatccttagctcggctcagataacgttaaaggagcgcgtttacaacattatatcttcgtcacccagtagacagtggaagcttacggatgttgccgatcatatatttatgagtacgtcaacgctcaaacggaaacttgcagaagaaggtaccagctttagcgacatctacttatcggcaagaatgaatcaggcagcaaaacttttacgcataggcaaccataatgttaatgctgtagcattaaaatgtggttatgatagcacgtcctacttcattcaatgtttcaaaaaatattttaaaactacgccatcgacattcataaaaatggcgaaccattaacattttttgtatctgtcacttaagtaaagatttttattaaaattgtaataatttaaaattcagactgcgcattaacacgctctatcaggatgggaggctattcaatatcattgttctgtccggaagacagcttatactgatatctatggtaatttaaagtaaggctgattatataacacgatttttgtgaacttgtcatcgctatgatgactggtaaaacgatattgccttattcacagcgtaagaattcgtccagatgacactatctccttccggctttaaccctgtggattaaggccggcattttattcatatttatacatcatccgttccctctgagaactatttgcctgaacggtttataccgaaacagtcacgcttgttagctttctgccaggcatacctcctctcttcctcctgatatcgatataatgcctggagccagcctgaggatgatactgctcataaccctcctgcctttttgacgctataactgaagggagtaaagaaaagacgatatcattattttgcaaaaaaatataaaaataagcgcaccattaaaaacagtctttcatttatattttggaacctaagacaaattacactcttaaactttcaacgaatggtcatttagtggaaatcttcgagaaaaatggttctgatggtgtaattatcagaccattaaccatgaagatataataagcagcatttacaccccaaaaaaatgcagtaagatagctacaaaactaatctctattgcaatgaggccaagttaaatatgtaaatatttagatgcccggcgctgactctctctgcaccaggatatacggcagcgtccattcgataatcacagttagttataacaatattattaccaacatgtcagttatttaaagcacaggcataagctaaataatcaaatgttaaaaacatataaacccgagcccgtagaatatgacattaagctcataataaaagctcaacctgaccgttagtactaacagcagaattactgaaacagtagattctatcctaacgacttgtattagttattataacttttcaccctgtaagagaatacactattatcatgccacattttaatcctgttcctgtatcgaataaaaaattcgtctttgatgatttcatactcaacatggacggctccctgctacgctcagaaaagaaagtcaatattccgccaaaagaatatgccgttctggtcatcctgctcgaagccgccggcgagattgtgagtaaaaacaccttactggaccaggtatggggcgacgcggaagttaacgaagaatctcttacccgctgtatttatgccttacgacgtattctgtcggaagataaagagcatcgttacattgaaacactgtacggacagggctatcggtttaatcgtccggtcgtagtggtgtctccgccagcgccgcaacctacgactcatacattggcgatacttccttttcagatgcaggatcaggttcaatccgagagtctgcattactctatcgtgaagggattatcgcagtatgcgccctttggcctgagcgtgctgccggtgaccattacgaagaactgccgcagtgttaaggatattcttgagctcatggatcaattacgccccgattattatatctccgggcagatgatacccgatggtaatgataatattgtacagattgagatagttcgggttaaaggttatcacctgctgcaccaggaaagcattaagttgatagaacaccaacccgcttctctcttgcaaaacaaaattgcgaatcttttgctcagatgtattcccggacttcgctgggacacaaagcagattagcgagctaaattcgattgacagtactatggtttacttacgcggtaagcatgagttaaatcaatacaccccctatagcttacagcaagcgcttaaattgctgactcaatgcgttaacatgtcgccaaacagcattgcgccttactgtgcgctggcagaatgctacctcagcatggcgcaaatggggatttttgataaacaaaacgctatgatcaaagctaaagaacatgcgattaaggcgacagagctggaccacaataatccacaagctttaggattactggggctaattaatacgattcactcagaatacatcgtcgggagtttgctattcaaacaagctaacttactttcgcccatttctgcagatattaaatattattatggctggaatcttttcatggctggtcagttggaggaggccttacaaacgattaacgagtgtttaaaattggacccaacgcgcgcagccgcagggatcactaagctgtggattacctattatcataccggtattgatgatgctatacgtttaggcgatgaattacgctcacaacacctgcaggataatccaatattattaagtatgcaggttatgtttctttcgcttaaaggtaaacatgaactggcacgaaaattaactaaagaaatatccacgcaggaaataacaggacttattgctgttaatcttctttacgctgaatattgtcagaatagtgagcgtgccttaccgacgataagagaatttctggaaagtgaacagcgtatagataataatccgggattattaccgttagtgctggttgcccacggcgaagctattgccgagaaaatgtggaataaatttaaaaacgaagacaatatttggttcaaaagatggaaacaggatccccgcttgattaaattacggtaaaatctgagagaggagatatgcattatttttttatcatcgtaatctggttgcttagcataaatacggcatgggctgattgctggcttcaggctgaaaaaatgttcaatattgaatccgaactactttacgctatcgcccagcaggaatcggcgatgaaacctggcgccattggtcataaccgagatggttcaaccgatcttggcctgatgcaaattaacagcttccatatgaaaaggctgaaaaaaatggggattagtgaaaaacagttgttacaggacccctgcatttctgtcattgtgggcgcctccattttatcagatatgatgaaaatctacggttatagctgggaggccgttggcgcttataatgccgggacgtcgccgaaacgatcggatataaggaaacgttatgctaaaaaaatttgggagaattacagaaaattaaaaggaatgtcagcagaagagaaaaacaaaagactttctatcgcggcaaacaaataattatacagaaatagcttactttcagatagttctaaaagtaagctatgtttttatcagcttgccgtcgtcataagcaactgggcttgcattgcttttagttgtacaaactgtgaggcgtcttccagcattctattgttccgtgaatcccggaaatctgcacgtacctgctccagattactatgaggattatccttaagtacaagggccgccgccatcgttccggttcttcccactccgcccagacaatgaatcatcggtaaatgcttatctgatgaactacgccccggcgcgccattttggttactatttttcaccctatccgccaggtattctaactgatccgtagacggtaacggctggtgatctggccaatttttcacatgcaataccgggattgtataccgcttttccccgcaggacagttgcatattgtattggtctatcgcttctccctgactggctgagctcactttttggctgttggtatgcacctcgccaaaggtgtagctccctctgaaatagggtggtaattgttttgcctgcatctgatcttccgacgttaacaccaccaggcacgagcattctttttcaagaagcattttcatatgcgcttccagcgcatccggcgtattttttgggtacgaaccggctaatgccacaggcttaccgtcaaaagttaacgtattcactggcacaggcattccatcgctcagtttcacctgggtttgctgattaattggaatgctgctgaccgcaaatcgtgccaggcccagtgtcggtccgctcatcgtctgtggcattggcgcgccggcttctattttctcaagttcagctgtaacatttttcagttctttagcaataacgtgaattttttttacagcctgggttaattcatgagtagaggctttatcaacccacctctcaacctctcctccacaggttccccattgtgagaaccgggctacaccgacctgaatatttgttaacgttgtaacataatcattaagttgtttagcctctggaattttatttaaattctgtaaattcgtcattaatgaacgcagcgggccgttacctgaagccatctcctggaagttttctcgcaggctatttccatccatttgttccagttgcggtaatgttcttttaagtccctttagcgcgatatcgagtaaaggttgcttactttctgctccaacatcgttatttttttctgccacttttgtatcgccgccttttatgactaaagcggcattcctgacaccaacattatccttgctcttaataaggtttataaacccttcgtcagcagcttttacacactccgtgatctgcactgctaaacgttgggtaaggggtttgttcatatttatacgggacattaacagtgcgtcattaaccgctgtttccccatatttttccgttagtgcatggagaaatgtctgtaaaatcttttggtcctgtactctgatattttccgtatgtttttgcaccacttcagtgtttttaaataacggcatttttccaagccaggttaatacttttgacgaaaatttttcaggcgcaacatatgccttatcagtattttccttagcaatataaagtcgggcatcattcgacacaccaacttttgaaaacgaagacaacgttaaattattcaattttctctcctcatactttagcatattcctgcagtatgtttttgagcgcttcctgctgattcacaaatgactcaagctgcgatataatatggtaagtatttgtcagatcggtaattgcatgtataagcaacaacgtctctgcggcatcaatatacgctaacgtaccttcattattcgcagccagttcaccattaatcaccataatctgccgccagatagaatcgccacaaacaggcgataacggtataatcataccgttcaataaccagatatcatctttagcttcaatagacgtaaaaatatcgctatcgagtaataataagcactgattgttgtcgtcaaaagtgagcggtaaacccaatttctcaccaatattagcgataatatcctggtgtgcttgcaatttactttcctcttgaattatatcttttataagattgcttcttcaaatttaatctggttacacaatgtcttgatactttttcgcgcccatcgccgggcgcaatatttctctcctttaatccagtagaatagccattcactacgcatcggaacacatatcagcagctccttcggatcattttcaacatgacgtaacttgcctttaataacaaaacgcgaactgtcagcaatatcatcatatattgcagccatacctgaaccgggtactacatgtgtgatgattttcataacaattaatcttattcaattgttgtcaagcgagagaaaaatactacaccctggactcaagactttttttaacaacacggcatatatccgcaaaggtcatcatatcaggaagatcgttttcattgcaactaatgtcaaactcctcactaagaccaaatacaatatcaattaaatccaatgagtcagcgtaaagatcctcaaccagatgggtctgaccattgatactatcaacatcaacggcaatacaagaggtgatcacttttttgactcttgcttcaatatccatattcatcgcatctttcccggttaattaacgctgcatgtgcaagccatcaacggtagtaataacccgatccacgccaggtttattcaggtatgactcgtaagccgggccagctcgccagctaccgtctccgataaggccgtccagcacattacttaacacatagtcagtttccccttttagcctggtcagccccgcctctctggcaaactgcagtgcaatctcagccagtttttctttttgtggatgatgagtaatgacctctttgagagtctccattttcgctttcaattctgggtgcttgtcaatatcgctacattgcgctttcaacgctgcactctttatcgtgtcattgggtaatatttccgcacgcaagccgtcaaacgctctgcgtacagggaacggtgtggaggtatctggctccagggctttacgtatcacacccaaaaacgtctcacgggcgtcgaaatgcattgaatgcatattcgtaacgctcggtactgttgagaggaaactattttgcttaaacttcaaaccagaaaatgggccagtcttatctgtctgactattatcattatcggtcgtaccggctttattacctgtaattaccgtcgtgtctgattgtaaggtatcggttttaacattctcgacgccagccagttgactggcaagcggcttcacattcacaatctctgccgtctggctttgctgtttattatcatcaacgccgtgcaccgtggcctgtaccggcttgccgataatgctcttgctggttacgccatcgacttcatcaaaagaggttgtttcacccgtagtgcccttttctgacgtgaccacctttccatctttactttcggatgaagcgttggtcacagcctctgccgtcgcatgagccgtgacgtcaattttacccgcgatgccatggtcaattgcccctgtgctggcgctgtgtgccgtctccgtttgatgcgtagtcgaatccacacgcgaatgactatgacttacgttgctgctgttagtcgaatggtgtgactcgccattgcgttggctgttatcaataaatgttcggctattatcaatcgtcttccggctattatcatggttgctattatcgatatggcgctggctattatcgacatggcttcggctattgttaatatgcttactgttatccacgctatggttactgctatcaatattaatattgatattaatacccgtaggttctgcttttttcccaccatcaggtactggtccagccgcaggctccggaattttagggtcaggcagtttatctgcaggaatttgtgcaaaaacattacgtagcagcaggggtatcaacgtttgcatttcaaggtgccgggcttcccgtcctacgctggtaccctgctcttgcgttaatttttggtggcacatatcaagcgcctcaacagccttcgccgccgctttgtcaacaaggtgcgtaagattgctgcgggttaacggatctaacgtacagccaaagttatgttcaatgcagctggcaatatagggcatcacctcctgcataacaagattcgtcgataatttacttaattcaccgccagtgttatttttgataatatctaacagctgcttttccaggttttccagcttcgcttccgctttctttgtttctggcagccatggcccaaaagctgacttttctttcaggccatcttttatgatttgcgcggtatactctgcccccaccttcatcagtagcgtcttcgcctcaggagaatcactggtggcgttgagcgctgaacgaaagagcccggcaaactccattatcgctttcttaccggcgacattatttgaattggtaaaaacttcttttaacgcctcagcgtctttcccgcatttaaacaatgcatccagactcgcctgtttgatcagcgcgggaaaatcttccagttgcgggcctttaatttcccctgacagcgtcgctgtggcactttctctgactgcggaaagattcgccgcaagattcgtggcctgcgttttgatctcggtctgcatacctggcattatgacggggggctgagtccttacacttgtaaccattattaatatcctcttctgttatccttgcaggaagcttttggcggtttccaggctgctacttatcgtactgctcagcacttttaccaggttgtcgtacaatgaattggcattgctatatttttgcgtcagcgtctgtaatgtggttttcatattttcttcctgcgctttaaaacccgactgccaggcttgatatttggcgttatccatttcgagttttgagtcttttcccggcgcgcctaaaccatcaatatcctgaaccattttttgtaatggcgtcagatcaacggtgacgacataaccggatccataagatttcaggcagctattcggtaaattcaattcactgagccactgtctcgcttccgcttcagtggctactttaacgccgctgcctgactgcgctggaaataaaacggtattactgtttatttgattatatttattgactaaactgtttaaatcatttttgagtgaggtaacatctagcttaacggtattaccgtccttacctggtaataaccagcctcccattttggaaagaatatcactgaaggcctgataaaaatcggtatagactgcgacaacgttttcataaacgcccagatagctgtcacctatcgccgatatattttgggaaaccatatcccaaatctcagcatcagaaatggttgttctcggctgcgccataggcgaagcgctaaataaggccgacgtcggcgcagaaaacgcgctccgcaggttctcattttgttctgcggataatgacacgccggacttcgccagcgcattcaggctgctggtcaactgctggcgcgccagcgtgcgctcgtcattattctcttcagagatcggtggcgttgactgcagcgtctgctgtgcctggtggattttagtagccgcctgcgataatgaaatgatatctgtaccgcgatgttctgtggtagacggtaccacggcagtctcgacgtgctcgctcgccgagggagtctgcggccgttcggcaacgatccccggatgaggagaagcggaataattttgaatattaagcataatatccccagttcgccatcaggagcgcgattaaatcacacccatgatggcgtatagatgacctttcagattaagcgcgaatattgcctgcgatagcagcgagtgcggatgctttcgactggttaatgctctccattgttttcagcatttcctgaatcaggctggtcgatttacgtgaactttcacgggcttcgtccgatgcggtgctggcaacccggttattcacctggctaatttgctgctcggaacgttcctgagtagcggcgtactgcccggacgcccctgcaataccaccgaccgtgaccgagttcttcataatcagatcgcccgtcatctgcatcttgcgcgcatcgattcgggtcatatccatggtattctgctcaagacgaatatcggattcgacagactcaagacgtttcgacagaatagcctgatgttcaggggagatttgtttattactgtctttaatacccagactttccgtggcgctggttccggcattagatttaagcgtcgcatcattaagatttttcgtcgcatcggtaccggttttcttcatatttaacgatttcagagaatcgacgccttcagcaccgagtttgacgctattctgcccgttcagcacgtttttaatactgtggctttcagtggtcagtttatcgatcttcgcggcattatgtttaagcgcgcctctttcattctgcagccccttatattccagtttggcgcccacgccagtgatccccaactgaagcgcgctctgggaaatactaccggacaacgcattcatcccttcgcgcatcatggagcttgccgtcgttttagctgcatcaaaactgactaatgacaacttaccagacagtttgctatcagcctggttcaacgtcagcattaacgtattcgcggcagccaacagcgcaacggcactggaagacattccgctaatatcaaaaaactttccgacttctgcctgctgctcgcgtaactgggtttgcacaacctcattcgctttagtcgtgacattatttgccagagcattcaaatcctgattcatgtcggtattttgaatactggcttttaaaaaggacgtgatcgttccgggggtttgcgttaatacccctggcgcaggcgcgctcagtgtaggactcaaccccaggtcactgactttactgctgctaataccaatactattcagaatatctttagcgctaacggattgcgaagctgtctgtgaactattctcaacagaatgattatttaaataagcggcgggatttattcccacattactaattaacatatttttctccctttattttggcagtttttatgcgcgactctggcgcagaataaaacgcgaagcatccgcattttgctgtaccgcagaagacatggctttttgcagttccgccgttaccttctggttttcaccaaatatttctacggattgtttaagccactgctgaatctgatccatggcaaaacgggcgagcataaaatcagcaagcgcctcgctggcatttttaataaatacgccctcggcaacaccaccggctgactgggctgcggtattcgtgacttccatgcccaacgccactttatttagggtattacctaccagctctttacttaaggcattcgtttgcaggcccatcttgctacccacattacccagaccgctagtaatacgttgcatcccctgggtaaagagtttgctgccgttttgcgccaactgtttcagcacgttaggcaccaacttcttaatcgtttcgcccatcattttgctcagcgcgttacccagtttcgccgccgcgcctttcccgacaactgcgaccaccacaatgaccgccaccatggcaatagcggcgacaatcgcaccaacaatgctgccggccatctctgccgttttcttatcgacgcctaatccttccagcgctttggtaatcgccttgccaatcagctccattaacggcttcagcacatgctccataatcgggtttagcgcctgctgaataaacgacactcccgtcgccgccttcacaatttcatcggccaccattaccgcaagtcccaccgcagccagcgccagactcgccccaccggtaaaaacagcggccacaacgctgacaatggttagcagcgcgccgaggactttcccgatacatcccataatgcggttcgtttcctcggctttgcgcgtctcttcctggaattcagccgatttcttttccatctccgcctgacgcccttcctgcaaggcgttgaaaagcgcaagatcgttttgcaggctttcttccgtatttttgcccacaatctcaataaacatggccatgagcatagtgaggcgggcgacatttgacagattatcctgctcaccctgggaaacctgattctgagaggcggcattagccgttccctggaatttggtcagaatgttatccgctttctcggctttcgctttggcgtctgtgcctgctttaaccgtcgcatccgtggccttatctaaggcctctttcgcctctgtcgcttcttttccggcctgttctaccgcggcttcagcttgtgcatagccggggtcagccgggtccagcgattgcaatttattttgcgcctgcgtcagttttttggtcgcagcgtcataaacactcttggcggtatccgtctttttgatactggcttcatagagatccgtcgcctcctgagcctctcccagagccgtctggaattctttcgatacctgaatccccatctctttttgtgactcaatcatcgcctgccataccgccagacgagactccagttgagacagcgaaacatcgcccagtagggtcattaacttgccaagcagtaatgtcaattgcccttcgctggagagtttttcccgggcggcgtccgtaggcggctttagacccaccgtattaatagcgctctcgccggactttgttccggctttaaggtcgcccgctttcgttgccaccacatctttaaaagctttatccgccgcttttaaaaagtccgtgttcttacgaacgccttcaaaagccgcctcagcgaggcgcggattttgggtatatccgctacggctaatgctacttgcgtcatttaccataattattccttttcttgttcactgtgctgctctgtctccgccgtttttagcgcctccagatagaccaacgcttttgcccgcagagactcatcttcagtacgttcattgacaagttcaaaacactgtctggcttttgctgccttacgcattaataattgacactgcccggtaaaaaaaacggggcgataatcatttttaagtaacgtaaacgctactgcataaaggtcacatgctttctgaaattgttttttcagttggcatactgccgccagtcccatggtgtaatcgggattgtaaaaatcataaatgcataagaaacgaaagaacgtctcagcttcatccagtcgtccctggttataaaactcataagcatgagcatataaaccgtccatcatatcttgagggatcccatgaacgtcttttagcgtggcgccttcactaacggcatcccaaatcatttccgcaacacgttcttcgctgacattattttgataatccattacttactcctgttatctgtcaccgactttgtagaacttaacgactgcgtttatctgatgcagttattaaaccccgacggtggttagtgaacattcaaaaaacgcccaatgaatacatcgctactgccttacgcggctcaatgccgtacctcgttttcttgtggctgaataacgtctttgcccgcgttttctacctcttccagccaaaccagaagacgtaaaacttcatcaatttcttccagactcaccagatcataacggcgatgggttttgaaaagactgcgcgccagtttgatatcgacgatcacaggtacgccaaccttctccgcataggcgcggacggccagtgcgcgctgattcgtttcatacaccgagatcatcggaatcggcatcaattcgggtttaaaataaatcccgatcgtaatatgcgtggggttggcaacaatcaggcgtgagttttcaatatcagatttcacctgttcagacagaatttccatatgaacttcacgtcttttagatttaacctctgggttcccttcctgctccttcatttcacgcttcacttcttccttatccattttcatatctttcatggtcaggaaatattccgcaatagcatccaataataagacaatcaatgcgcaagcaaggcaagttaataccaatgcgaggagaagttcacgccaaatgacggcaatacctacaatattgccatttagctgagaaaagatttcaaccttatatttcttccagcaaatgatggcggccaccacaaaggatgagagatacagtagggttttgaccgtatctttaaccgtgcgcatactaaaaagtttttttgccccttctaccgggtttaacgccgataaattaggctttaatgcttctgtcgccagcacaaaaccggcctgtaataacgccggtaatgcggaacacactaagcagagcagcataaatggaatcagatattttaaccctatcccaaaaacggccaaactgtagtcagccatgctctgatcaaaattatccgcaataatgatcttaattatccccataaactcattaaatgagccatacgacaccagataggcaattcctcccagcgtcaggcaggcgataatgagatctttacttttaaatgactggccttttttagcggagtcttccagccgttttttagtcggtttttctgttttattcgaggacatgcgtcgcccctcgctcgtaaaaccaactgcttaaccctgtggcctggaaagagagtcgcagtacattgtccggtagtaccggagagaaataaagcagcataattaaaacggcaataccgctttttaccgtcagtgaaatcgcaaaagcgttcatttgcggagcaaagcgcgacaataaacccaggaatacttctgacagcaacagcactaataccaccggactggccagaaccaaggcgttttgagccacctgattaataaacgttaatagcggcggtaatgaaggcgtgcactcgttcatcggatcgcatagctgatagcttttatttaacacgtcaaccatcgtgaccagaccgccgttttgtaaataaacgacagcggcaaacatattcaggaaattagccatttccgaggtatcaataccgtttgccggatcgatactactacttagcgttgcccctcgctggttatcgataatacaacccagcgcatgcataacccaaaaaggccatgacagcagacagcccagcatgacgcctaccgccgcttcttgcagaactaacgggatcatcgccaccgataaaaacggcggcgcctcgttcaatgcatgcggccatactcccaatgccaccaggatgataatggcgtttctcggcgcaccgcttaataccccgctattcaaaaacggcaggaagaaaaaaatcggcgccacgcgagcaaaccctagcgccgcagacgcaaccaggtgatgaatttcaaagtacaacgcgtaaaacattttttaccccttagccaacgccaggaatatcacctgacgcccgtaagagagtaaaacttcgccataccagccagacagtaaaaacaagcataaacacacgccaagtaatttaatgccaaaaggcagcgtctgttcctgtaattgcgttaccgtctggaataaccctaccaggaggccgataatcgttgcgacaatcgtcggccaccctgacaggatcaaaacaagatagagcgccttattacctgcaaacactaaatcatccatttaactatcccgtctcgtaatgatgtcatgttgcaatgtccatatactgtaatatcaatcccttagacagtaaggtccagccatcaagcgcgacaaaaagcaccagcttaataggtgtagatatcgtcaccggactcatcatcatcatccccagcgccagtagcacgctggataccaccaggtcgacgacgacaaagggcaaataaagataaaaaccaattttaaacgcgctttttatttcgctcagcgcataagcaggtaataacgcaaatattgaaggtttttcaatttcatctttgtcacgctttaccgtctcggtctcttctccatactgacgcttcagttgcgcgttttcaaaaaactgaactaactcgcgatctgaatatttgatcagataatcgcgataaccatccagaccttcatcaacgtgtttacttaatgatgaaatatcattaaaggtgacatcttcgtcctcaaaatagacgtaggcatcatgcattatgggccacataacaaacatagaaagcagcaatgcgacgccgttaagcgtcatatttgaaggtatctgctgtaatcccagggcgttacgcaccatgacaaatacaatagaaaatttaacgaaacaggttcctgacgcaataataaatggcaacagggtggaaaatgccagtaaggcaattaatgagatatcattccccattaccagactcgctcagccattcatggatctcaacgcctaaggtgtcattcatctgtaccagttcgccattacccagcaaaacaccattcgccataatttcaacgttaagttcagcattggtcggcagtgataatagctgttgctgccccatggcttcgagttcggcgagggtaacgttcttacgatacaaaacaaattccagtttgacgggcaattgattcaagccaggcagagtttctgcagtttcagttgtattattttcttcttcgatatgttgaatatctaacgtttccacaataattcccccttcaacacggttgaaatgacctaactttttcgcgtagcaataaacttccgcacgggaagtacgaatcaggagtacatctccgatcccgattcggcccagcaacgaacgctgcgtatcactgctaccgattacaaagcgcaacggccaacgcagcattttcggcctgccgcccccgactgcaggcagttcaggaagatgctcaaaccacaggccgccccgatcgctcataatgtgcaacaatttcccttccggcagcgcgcttcccggtacggggttctctacgcataaacgccgacaggacaaatgcggcacgggcaactcaaacggtcgctctgttgcagcaagccagggaacgaccaggtgctcagcgccagcagaaaccgccgccccagccagagcgggagagacatgctcaagccagtccccaggtttaatccaggccgaccaccgtttttctgcatcgctcaaccgaacccacattccctgtcgcgtcggatattccagcgtcgcttcccggccatggcgctggcattctgtcgcggtttgcgccaatagccattcgcgacgatcaatctgtctcacacgcaatgacatcaggcgtcatcctcctcgccagattgctgtctgtgctgttgctgctgcggattttgttgatcgtctcgcgtcaggtgccagcgctggggattaccgttttgccattgatcatgcaaacgatgttcaacctgcgtatttgacggtattaacgaaaactcccctgcttgccgcgcctgaatattgacggaatagtcatttccccagcgctgaaaacggtaagtcagcgagctatcctctcctttcacgccatcggcagtgggaaaaatagtcatcatcggctttgattgcgccgctaaaggcattttttcatcgccgccggttaattggctaagatcggcgatagtggttggttgcagcggaagctgagaaacatctttaacctttttatgatctttatcttcaggcttaccggtattggctgcggccattcgggcaggtgcgacatcccgcgccagcggcgcgccctctttacgaacgccttcgcccgcgatggctttattatccccaggcaatgccttgatattatcgtcagagattcccgtggcgttatcggttacttcactaacggattccacagcttttaaatcagcagataattttttaccgcttacgctttctaacggcctatttttagacgatagcaacgctgcggatttatctactttggcctccgcagagatcaaaccgacagatttttcagcagtgactttcaacagtttttcagcaatcctgagttcgctttttccgttatgatgcagaccagaaacgttgccattgtgatgttctgatttcgctggcgcgccatgtcgccatgccgccagtaataacggtaaagccgtttctttatgcattacgaaagcatcgccatagtcgcgatcttttttatcaccggaatattctgtcttatgtttttccaccgctttttttaatgcttctgataaaccgccaacctcatcctgctgcggcagtaaaatgttcccggatgaactgacagctgacacatcgcccattaaattatctcctctgactcggcctcttcctgctgtatctctcgctggatatagaatcttttctgacggattatccagcgttgatagttcccttctttgcgcaaccaatatttactttttttctgaaactcttcccttttcttttccagctcgctccgtttttcctgaatttgtataatctggagttctaaatcttttatctgccggcgaacaatagactgcttacgtaataacgtataaatttcctcacgactgagctgtctgttttctgcacgcagcgtatctaataacaatttcagacccgctatttgttcaaggatcgcctcctcctcggcctgcagcccgcggtcctcatcctgatagcgaagtaatatcgactcacactgtgaatgaaataccgtacagcgccgctgcaatactttaattctggtcagcgaatgcattcataccgctcaacgtgtcatcaaaggatgaatactgcgctaccggctggcataaccaggctttcaggctatcccgcatctgcatcgcccgatcgttatcgatattttcgccaggacgatattctcccaagtcaatgaaaagctggagctcttccaaacgcgtcattaatttacgcacggcagatgcctgttcagcatgtgtcggcgtcgtgacttgtccaaaaacgcggcttacgcttttcagtacatcgattgccgggtaatgtccctgcccggccagctttctgctcagatacaggtgaccgtcaaggatagagcgaatttcatccgccatcgggtccgcctcttcctcgctttccagcagtaccgtataaaaggcagtaatgcttccctcgctggtcgcccctgggcgttccagcaagcggggcaaattatcgaatacggaggcgggataacctcgacgagccggacgctctcccgacgccagtgccacgtctcgcaaagcacgcgcataacgggtcatggaatcgataaaaagcacgacccgttttccctggtcgcgaaaatattccgctacggttgtcgccagttgcgccgcattgcagcgatcgaccgaggggaaatcggaagtggcaaaaaccagcacgcatttttctttcttatgcgaagcgcgcaacatatccacgaattcagtgacctcacggcctcgttcaccgataagaccgataacaaagacatccgcctccgtttgctcgatcagcatatgcatcagcatggtcttaccgcatcctgcggaggcaaaaatgcccattcgctggcctacgccacaggtcaataacccgtcaatcgcgcgcacaccggtaatcagcggttcacggacgccaacgcgtgaagcgtaagacggcggtgcgacatcaataacgcgttcttcgctaatcggcgccacttcaggggtaaaacgctcaacgattttccctgtcggatccaacaccgcgcctaataccgagtatcccacccacgccgataacgcacgtccagtgggataaagcacgacatcgcggctcagcccctgggcattgccgataaggctcagcacggtgcgttcccgctgtaagccaaccacctgcgcacgtgcaacaacctgtttttggtgccagccacggcgtatttcacacagttcgccaatggccacatcgcgcaattccgcctcaataattgggccggttattttttgtgggtaggccagatattgcagtaaacgaggtgttttcatctcattagcgaccgactaaaaacttccagatagttgtaaaacccattcaaggcagtagagaacttttcaccgtcagataaaaaatccggatgcactaaggctttaagcgttagctccccattctgctcccccagtagtaattgcccgccgcgggcaaaatggcatccttccattatggtcattaagatttcataagcccgctgttgtaataccaccatgctgtcagcacccaattgcgcccagatccatacatcatcgtccttgacgctgatacagatacttggcaatgcaaataaatccagaacaattgttgaatggctatctattcctccaattaatgaaggatcgcaaccacttacttccagtgcggaacgaactaattcagcgatatccaaatgttgcatagatcttttccttaattaagcccttatattgtttttataacattcactgacttgctatctgctatctcaccgaaagataaaacctccagatccggaaaacgaccttcaatcattttcttaataaatcgacggacatcgacagacgtaaggaggacaagatctttatgtgcaatcaataaatcatccaacttaagtgtaatgagatccatcaaattagcggaggcttccgggtcaaggctgaggaaggtactgccagaggtctgacggatccctttgcgaataacatcctcaacttcagcagataccattactgctcgtaattcgccgccattggcgaatttatgacaaatataacgcgccattgctccacgaatatgctccacaaggttaatgacatctttttctcttggcgcccacaatgcgagcgcttccataattaacttcatattacgcacggaaacacgttcgcttaacaaacgctgcaaaacttcagatatacgttgtaccgtggcatgtctgagcacttctttaagtaaatcaggaaatttcgcttccagttggtccagcatatgttttgtttcctgaataccgaaatattcattgacgttgcgcgccagcgtcaccgccagacagtggtaaagctcatcaagcgcgttccgcaacacatagccaagctcccggagtttctccccctcttcatgcgttacccagaaatactgactgctaccttgctgatggattgttggattaataccaaaggacacgacttcatcggaataatttaccactcgcatcaaatcaaaatagaccgtaaattgttcaacacggatctcattaatcaacaatacgatgctgttatcgtccaggccctcgccatcgcgtaacaatacttccggcaggcgcacgccataatcaataaagaactgactacgtagacgctccgcaagttgagctttttccagatcttcacgccggctcttcggcacaagtaatatcaacggtacggtctctgtagagactttatcgagatcgccaatcagtcctaacgacgacccttctttttcctcaatactgagcggctgctcgcctttgctggttttaggtttggcggcgctacgttttgcttcacggaatttaaaatagaagagtacgcttaaaaccaccgataaaataacaaaaaccggcagtgggaatcccggcagagttcccattgaaatggtcaaaatagccgtaacaaccaatacaaatgggttgttcaacagctgcgtcatgatattccgccccatattatcgctatcgccatttacgcgggtcacgataaaaccggcactaatcgcaatcaacaatgcggggatctgggcgacaagaccatcaccaatggtcagcatggtataagtagacagggcggaggacaaatccataccatggcgagtcatccccaccgaaataccgccaataaagttcacaaagataataatgatgccggcaatagcgtcacctttgataaacttcatcgcaccgtcaaaggaaccgtaaagctggctttccctttccagtacgcttcgccgttcgcgcgcggcatccgcatcaataataccggccttcaaatcggcatcaatactcatctgtttaccgggcataccatccagagaaaatcgggccgcgacttccgcgacacgttctgaacctttggtaataacgataaactggaccacggtgacaatagagaagacaacaaaacccaccgccaggctatcgccaataacgaattgcccgaacgtggcgataatttcaccggcatcggcttcaatcaagataagacgactggtactgatcgataatgccagacgaaagagcgtggtaattaacagtaccgcaggaaacgttgaaaaactgaggattctgtcaatgtagaacgaccccataaacaccaatatcgccagtacgatattcagtgcgatcaggaaatcaaccagataggtaggtaatggaatgacgaacatagaaatgatcatcaccattagtaccagaatcagtaattcaggtcgtaaacgagcactgttaagtagagaaagcagcactataggtatcctgttaatattaaattaagacagcttttcaatagtacgacgctgttctgccatttcatgcttgtaggcaatatcggtcatactacgtaacgccattaacaattcttcctgccaatattcttcataaaagagtgaagagggtatggctttacatacttgataaaatatctgcaaaaaggatgcatgttctttatgactaagcaataacgcattcaaacctataatatcggctaacagcgaatccacttcatgtggctgttgcaatagcgaaagcatcagtagtaaccacgacgactcctccgcattaaacgctttggtaaacgaatacgacaacaatgtactcacaaacagtaggtcagcggagcgcaacattttaagttgcgtcaggcgtcgtaaaagctggccaaactccaggcgcgaacagctggcgtcattcgcgtcaatatcggttaatagcgaaccctcaataaaatccagtaccaccagtcgacgttgatagccataactggctatccagtcagagtaaatctccacttcatgtgattcactctggataaattgccgatagctggcgcgcaataagcctggttttaacgataatgttttcccaaaaagccgggccttcaacgcacaattaatccctgccttgagggtcttcggatcggtttgctcttcaacgtgcttaagtaacgactccagctttttccgcacgatctcttccaggtctttacgacgaagcaattcgcgtaacacaaggactaaatcactggggtcaggaaataagctacgcgcctgacgtaaaaaatcttctaacgcgccgccatgtacgctaattagctttaagatttgcttcgccttcggtaaagcctcatcctccagcacgcgttcaaaactgttagataaattactggattttttttcataatcgcgacggttacgaaattgcgccagcgccgctgacatttcgtccgtcgactggacaaatttttgtacttccgcccctggagacgaatcctctgcggcctgttgtatttccgcctgttgcgcatcagtatgctgggtcgcatcctgatgagatgtctgccgggacaatattctggaaaatgaaataccggaggttgagccaggaatcatttaattgcctcctgacctctatccagataaacacgaacccatttctgtaacttatcgtccccactccaggcaccgctttgcttcagaatattgtttaccgattcgctggcatccggcgttaacgggtcgacaatttcttttggttcaatcatgaacacacgaacaacattacttttattcttactggaataacggaacaggctaccaataagcggtaatttgcctaaaaacggaatactttggacagtatcggtatttgcatcccgtgtataacccccgaccagcaaactttttccgtgcggcactctcgcaatagtgctaattaacgttcgcccgacttcgggtaacgcatctacggaggtggtagtatcagattgcggcgtcttatcgttgccatcttcaatgtccagcgacatttctatctgaccatctgcggaaaaacggggcagcactcggatcattgttccgtatgttacatgctcaagcgccacattacgttccccaatcagcttggtgtaaaacgttctgttgttatcaaaaatagcgggaacattttcctgagtcagtaataccgggcgcgaaaccaccgtcgcctgtttcttctcttctaacgcattgaccgcggcgatgaatcgactgccatcgagggtacttattgaagactggtttaatgacacgccaagtttgtccccaatagttatgctgccgctccatgaagtgcccaaacgctccagatcgcttttattaagatcgacaatccacagggataattctacgtgacgtttggcgacatccagcgctttaaccagcatttcgataaaatgcacctgctcagccgttccctttactaacaaactgttggtatccggataggccacgattttaatattgcccgccgcggcattttgctttaaagcttcctgcagactcatgccaccggcataatttgctgctttacctttttctccattcgctgaaaacgctggcatcgccgggggttcgctactgacaatattacctaagggttgctcttctccctgcaataacctttcaatggccgtagcaataccgggaataaccattttctgatcgcgcagattataggtacgatcgcccacgaaggtattgttcagacgcatcacccctattttctggcgtcccagctcaataccatcgttttgcttgtccatcatggtggcggcgttgaccaccatatcaacatagacgggtggccctgaaacatagaatgttcctttacggttatcgccacgtagcgggtaatttttgttatataaacctgagcgttttagaaaattgttgaactcattgagtgagacgttgcgtaaagaaaccacggcattgcgcatttcactggcgtcataaatatagatagcctgcccatcgaaataccaaatcagccccagttgtagggaaagcttctccagtaatgcgttaggatcgtgaaactcaaagttgcccgtaattttttttcgtgccgccattttgctaacaatgacaggctcctttagctgtagcgccatggcatcgaaaaatgtccgcaggctatcgtctttcgcaacaaacccacttcccgttacaggtattttttcactagaataaccaggtgtaaccagaacaagcgcggcacatgccagcactctggccaaaagaatatgtgtcttcatttgtctgccaattgaataatatttgataatttccgcggcgaaacgccgatcagctctttgatctcactagaaaaatgtgaaggcgatgagtaaccatgattaacggctaattgggtgatgttctcgtggccttctacactattcagcagcgattgcgccatacgccagtttcgtaattcactcttcgcttttccgcccaacgctctgctgcacaaacgacgaaaatgggtataagaaacgccatagtcttctcccagcattctcatcgtgttgccgctggttgactgagcgagtaaatagccaaccaaccagtaactctcgctttttcgtaacagcgccagtaccttattgaaggccggagaaggcgtaataatttgctgcaaaaaccagtactcgcagcgtttacgatcttgccaaatagcgcgaaactcaggactcagcaaaacccatttatcggattcagcatatgtcgtgtccactaatcctgcgccatcgataaatgccagtaatttgctgagtacttcaatttttaacggtcgaaaaaccaggtctcctgatactggtgcgacaacggcctgctcgcaaaaaagcagcgcgccttcctgaatcaggcaattttcattgtgtcggctttcagaaaatgacatatgcagcttttgcgcggaacacgtctgtataaaccatgcttccgggctgcggattttccgcttctctccttctttaagtacttcctgcgtatttagcatagttgtcagcaccagttaaaaatcattttaatatgtaaacaataccgggagcgggtggcaaaatcctgatgcaatcattatgaaactgatgccgcccgctaattaaattggccaacttgcatagtgtttgctgatttaaaatagaaaattagctcatagtgtataaattctggcttattgttctgcagcagcaaaaattcagatattgtcatctggatggagaattaattatttatatcaggagttttttttgctagcattcctgaaacgcattcgcccccttataactattgtcagataacgttctgacggttgtgtaaaaacatggcgcctcattcttctgtagttggagttaatatgaaaaaattttatagctgtcttcctgtctttttactgatcggctgtgctcaggtgcccctcccttcctccgtgagcaaaccggtacagcaacctggcgctcagaaagagcaactggccaacgcaaatagtattgatgagtgtcagtctcttccgtatgtgccgtcagaccttgcgaagaataaatcattatcaaaccataacgctgataattccgcatcaaaaaatagcgcaatcagctcaagcattttttgcgaaaaatataaacaaaccaaagaacaggcgctcaccttcttccaggaacatccacaatacatgcgttcgaaagaagatgaagagcaactcatgaccgaatttaaaaaagttttgcttgaacccggaagtaagaatttaagcatatatcagacgttacttgctgcccatgaaagactgcaagccttataaggccatatcaccgttggctgaactcatcatgatataattaagaccatattttgcattgccacttaatatcaatataattattatagctatggtcacttttacggttggccatttgtctcttacgttgcatttatcaatctgctttttgatacagcagcacctcgctgctgctttttttatttgtgataaagaacggcctcccagacttgggaaatagccgaaacttatactgacaaactatcgtctcgtatatcgcgataaactgacatccccctcctgccccacatgttggcattcttacgataccccatccacttttcgcggataacgctctttttacccgtgacagcgtattgacgaccaggctagtatagcggcagaaacgtcccgatgcctggaatgaatggcaaacagtctataaggtgattgaatggatacgacagaagaactaaacggaacctacttctaccacggacaatcgaacctgtcagcaggtgaactatttgatgtaattttcattgagcaattttgtgatgaacttgggattggcattgagtcaggtgctgctatcctcgccgggcaaccgtggttaaaaaccagaacgaaaccgggagaggcaatcaaagggacaagtgttatctccaggtatgggagaatgcttttacgaaatgcacgaactccttttggtattagagttcctacacccgttggtataagaatgcgaaaaacaaataatcttgccgcagtcatagcacgatatgttccatggttaggttgggttggtcttgtgaattcaatttaccaggtatcaaggagaactcaggcaaaatacaacctaatagcacgccctaaagatcgtatacaatggacatccttttgatggacacaattcagcaagaggtgttagcactcttccgtgaagagattcccggatatttagacagcaattggaaagaaatcccattagaacttgattctgatttatttgaagctccaggcgatgacctgcatgaagctttggataaatttgaaaaaaaatttaatgtagatttatcacaagttaaatggtcgtgttatttcccttgggagaatactccactgcttacacgatggtttaaattaaaacgggaagatgtagaacgaactcgtaagcctttaacaatcagaatgttttctgaatcagcgaaagctgggaaatggctttatgattaatgaaaaatatgtcgaattaatcaggagctaattactatgaattttgttaatcgattaaaattaaaagtagtaaatttcatatacttttcaaattaaaataatgtgttgtatctacctttcgaccaccagtaactctgacgccatccgttttaaattgaccatttggttctggtggtatatcgcaagtagatatttctgaagtgcttgactattcactcttttttagcctgcatgtatggtggcgacgatgctgttacataggtaccggtatattaccaaattgattctgccagatatcccgcctcacgtagagcattcataattttattcgctaattcatactgatattcatacgaggtattctccatggaaaataccgttaattcatatttataatacagccaaccatcattctcatttatcaacttaggattacagtcataatttctttctattgtaatcattgtattttcgtatcttaaatataataagttcacttttattatgtctggaatcccttgggataaaaaatcaattaactcatatttatccagatcagactcaacaacgattgtgaattcagagttaacttcttccattatggaacctcaatatatgggcctctattaaacggtgatgattgtttcattaccgatacctgtatttttgttacatcatccggatgaaagtgtaggatatacatcctcccatatgccaccttcatcaccagggcctaatgcacgccgttgagcctttgttgatttttaaccttctgatcttactcagcaatagtggacacgcaactaagtgagtaaacgctcaagcaagaggtgactcacatgacaaaaccagcatcaaccaccaataagccacgcaagcagcacacgcctgaaagccctgaaactggcggaacgcattggggtggccgctgccaccagcgagcttaacctgtataaatcacagatctacagctggcgaaactcagctctcttcttctgaacgtgagcaggagatgtccgccgcttagggttgtgtccctattacgcgggtaggatcaatcaagcagttacggcaaaaaagagaatcatggatatatttagcaaactccctgatgatacgtaatcagtgagattaaaataatgcaatcgcgataaaccgaagttaatcccctgtttaaagacagtgagcgaccttcttgccatgcctggactatatcagcctcatatgtacgccttgaaagcgtacagatatgtattataattgtacatattgttcataaacaggaggatgaaaaccatgcctcagatagctatagaatctaacgaaaggctgtcgttacgtgtatcgacggatgccaaaaagttgatagtccgcgctgcggcaatccagcaaaccaacctgacggattttgtggtcagtaacatactacctgtcgcacagaagattgttgatgccgccgaacgggtatatctgacggagcgcgatactaaaatgatcatggaaattttagataacccgccagcgccgaatgaaaagcttcttgccgctgctttcgccctgccggacatgaagaaatgatgtttacagactggcatgaggccgcgatagggaaaacccacaatcgaatgaattttgattgtggggatgccgatctgaaccaattcctgcaacgccatgcacgacaaaatcatgagaaagggacaacgaaaacctatgttgcgcttgataattcggatgttacacgtatccacggcttttactcagtcagtcctgcatcactgatatatgcacaggttcccggcgcaatcagcaaaggattagggagatacgatgtgccggtgtttcgtctgggtcgtttagccgtagacaaatctatgcaggggcaagggctgggagcacaacttttgttatctgccggaaagcgttgcatacaggcggctttgcaggtcggtggcgtagccctacttattgatgccaaaaataaacaggtctgcgactggtacaaaggatttggcgcagtaccattaaacgatcaacccctttccttgttgctgtcgtttaaaacgctttatgctgctttatctgcatctggtaggttatgacaacatgaggctttgttgaataattcagaatcggccaacgataaggatacaggactcccaccggagcactcgttatacgagcctgacgctggtcggcattgccaacaacgtcatccggttcagcgctttgaccatcgccatcgcttcacccacctgcgcgtcatagttccgcaggctcagatggccgcccagcaaggttttgatacggaacatcgctgtttccactactgaacgacggtgatagcccactttcttttccagacctcattgctgccgctccgatgttgattttaaacttttgctttgccatcggaacccgatgctgaaacgacagtaacgattagatccgccaatctctttattcaacaaagccccttcgggatagagcttccgctgagcgggaaagtatgcctttgcaattaatcaataaagtgttgcgcgagaaatcgtgcatctttcaagcacatcgtctactttaattaaccgattcataaaatatatattatctgttcatttctagcctgtaggatattttaataactgtatattttaaacaataaaaattaatattggcctacttttttgttataataccagactccaaaattgtgctataggaacatcatggaattaattcgttatgctgacatcaacagcgatctctatcgccacatttgggtcgttggtgatattcatggatgttactccttattgttaaccagactggctcaattaaatttctctcctgataccgatctcttgatctccactggagataacattgatcgaggaaaagaaaaccttgaaacactgagactgttaaataccccatggtttatttctgtagtgggtaatcatgaagctatggcgcttgacgcttttgaaacacaggatggcaatttctggtatgtaaacggtggttactggtacgactcggtcaccgaaaaagacaggcaagaagccactgagctattactaacttttaagcagcgtcctcacatcatagaagttgaaacgtcctcaaagaagtacgtgattgcccatgccgattatccagatgacagctacgattatgggaagcaagttgatattgatagcgttctatggtcacgcgatcgtctgcttggttcgttacaggggaatatccatccaatacgcggtgcggatacttttatcttcggccatatgattgttgactacacaacaacattcgccaatcaaatctacattgacaccggttctttctgttcaggcaatctgtctttttttaaaataaagtaatctggaaatagaattatataatatcaaccctccctgcattatgggcaatgatatagccttcaataagtaccattgcccattcgtaatagcgtctaaatttcgcgtttttctgcccatttcagcattaagatcgcaggccaaaaaaacgaagccgtaatccgacgcaggtagttactcgatcgcctgagaagagtaaagatcgcacagctccagatacctatcggaagaaaacgcaataaccgtggtggcgaaatggatcggcttgccttcatgcaacacaatcttgattacagtctcgagttcggaagcatccgtttccctcttaattttgttgaaatttctctttgttgcgagcatggtctgaactaattgcctggcagcttgccttgtttcgtcaatatttggaaaatcgaacacatttccaacttttactttcaagacagaacttggcttcctaccctcactgacattacgatctgacgaggctactcttcgctggattacgtaggtttttttcgtcaaactggcttttaccccgaaaccagcaggagcttctctgtggtcatcgaaaacagtgtagagtttttgagctgggttagcttcgaaaacgatttttccagagcgactgagtgcaggcttaacattgatacttaacttgttgataatgaaaggctggctgagagttgttttcaaagtatcacccctgttgtagtccaggaatgatgagaatgtaacctgtcacattttaggctacaggtgagctacaaatttatgggtttatgtgagtttataagggttttacctggggccacatgagcacttgaaagaataaaaaaacgagtaaaatcaatatgaatgagtcatttgataaggacttctccaaccacaccccgatgatgcagcagtatctcaagctgaaagcccagcatccggagatcctgctcttttatcgtatgggagacttttacgagctgttttatgacgacgcaaagcgtgcgtcgcagttgctcgatatttcgctgaccaaacgcggcgcatcggctggcgaacctatccctatggcgggtatcccgcaccacgccgtagaaaactacctcgcgaaactggtcaatcagggcgaatccgtcgctatttgcgaacagattggcgatccggccaccagcaaaggtcccgttgaacgtaaggtcgtgcgtatcgttacgcctggcactatcagcgatgaagccctgttacaggagcgtcaggataacctgctggcggctatctggcaggatggtaaaggttacggttacgccacgctggatatcagctccgggcgctttcgtctgagcgaacccgccgaccgtgaaacgatggccgcagagctgcagcgcaccaatcccgccgaactgttgtatgccgaagattttgctgaaatggcgttaatagagggacgccggggtctgcgccgtcgcccgttgtgggagtttgagattgataccgcccgccagcagttaaatctgcagttcggtacgcgggatctggtcggtttcggcgtcgaaaatgcctcgcgtggattatgtgcggcaggctgcctgttacagtacgtaaaagatacccagcgcacctccctgccgcatattcgttccattacgatggaacgccagcaggacagcatcattatggatgccgcgacccgccgcaatctggaaattacccagaacctggccggtggtgtcgaaaataccctcgccgcggtgcttgactgtaccgtgacgccaatgggtagccgaatgcttaaacgctggctgcatatgccggtacgaaataccgacatattacgtgaacgccagcagaccatcggcgccttgcaggacaccgtcagcgaactgcaaccggtgctgcgtcaggtcggcgatttggagcgtatccttgcgcgtctggcgctgcgcaccgcgcgtccgcgcgatctcgcccgaatgcgtcacgccttccagcagctgccggaattgcacgctcagcttgaaaccgttgacagcgcgccggtacaggcgttgcgtaaaaaaatgggcgatttcgccgagctgcgcgacctcctggaacgcgccattattgacgcgccgccggtactggtccgcgacggcggcgttattgcgcccggctaccatgaagagctggacgaatggcgcgcgctggcggacggcgccaccgattatctcgatcgtctggaaattcgcgagcgcgagcgtaccgggctggatacgctgaaagtcggctataacgcggtacatggttattacattcagattagccgtggtcaaagccatctggcgcccatcaattatgtgcgtcgccagacgctgaaaaatgccgaacgctacattattcctgagcttaaagagtacgaagataaagttctgacctcgaaaggcaaagcgctggcgctggaaaaacagctatatgacgaattgtttgatctgctgttgccgcatctggccgatttacagcagagcgccaacgcgctggcggagctggatgtgctggttaacctggccgaacgcgcctggacgctgaattacacctgcccgacatttaccgataaacccggtatccgtattaccgaaggtcgccacccggtggttgaacaggtactgaatgagccgtttatcgctaacccgctcaatttatcgccgcagcgccggatgttgatcattaccggccccaatatgggcggtaaaagtacctatatgcgacaaacggcattgattgccctgctggcctatatcggcagttacgttccggcgcaaaacgtggaaatcggccccatcgaccgtatttttacccgcgtcggcgcagcggacgacctggcctccgggcgttcgacctttatggtggagatgaccgaaaccgcgaacattctgcataatgccacggaaaacagtctggtattgatggatgaaatcgggcgcggtacctccacgtatgacgggctgtcgttggcctgggcctgcgcggagaatctcgcgaataagattaaagcgttaacgctgttcgctacccactacttcgagctgacccaattaccggagaaaatggaaggcgtggcgaacgtccacctggatgcgctggaacacggcgatactatcgcgtttatgcacagcgtgcaggacggcgcggcaagtaagagctatggcctggcggtcgcggcgcttgcgggcgtccctaaagaagtcatcaaacgcgcgcgccagaaactccgcgagctggaaagcatctcgcccaatgcggcggcaacgcaggtggacggcacgcaaatgtcgttgcttgccgccccggaggagacatcgcctgccgttgaagcgctggagaatctcgatccggactccctgacgccacgccaggcgctggagtggatctatcggctgaaaagtctggtgtaaacgtgtcagacccgatagcgccgcgctatcgggtctgcgcgccggaacaggcttttcaggctgtgactgtcgtttcgtgtaaatgacgccagactatccgtcctctttccctttttaaaatgaccgtcgaccagcgtaccgtctcggcctggcccggcagttgctgtcgctcacgataacgcagcgcggcgccttccggccactccgccacaaggtcaatgtgctcaaccacgataaccagacccgggcgacacgcgcgctgcgcctggaaaaaagcgcccagcgccggataatccagacaaacaccgcctggcgttatcatcgtaaaatcagcagcgaaacgcgctatcaacgcctccaggctacccacccccttactaagccagttctcaatcgccgcatgggcatgaataatttcttctttatatggattcatgatctttcctttttcaggcacagaagcgcctgtctattgtttagacagacagcgtaaataaggggcagcagggtgataccggcggcggcaataaaggtccagcgataagcaacctcaagcgacataacgcgctggagcgcatttaacagcagcgtcaacagcgtcgcgccaaggaaaaagctgatctgacgattaagattccatagcgcgctggcgtcaggcatgtcccggcgagcaatagtcaggaaagcgccactctgcgcggtactgctgcacaaactgccgccagcgcccattaaggcgaatatcatcatcagtacacggtgcgatgtcgcaggcgtaacgttagttaaaagcagtatccctgcggcctgaagaagacagccgacgataatcagcggacgcggcccaagccgattgaagtaacgtccggtaagcataatggcgacaaatgaagcgatcgaccaggggatcatcagcgaccccgccgccgcaggcgatagctgcgcgacgttctgtagataaaacatcccgaccacgctgataccaatgaacatacccggcacacacagatagacgatcatggcaaaacgcagcagcctgtccgtcaacaacggcagatggagcaatcttgctgacgccattgtcgtcgacgcgacattcagccaacgataagcgagcaataaggtgagaacggccaccggcagcgtggcaaagaatatccagcgccagccgcacgtttccaccagcagcccgccaatcgcaggcgaacatgccggcgccagtagcgccaccatcatgacaaccgatgacacgccagcgcgttcatgcggtttaaactgttgccaggttaacgcctgaccaaccgggatcaataagccaccgcccgccccctgcacaatacgccagaaaacaaggctgtgtaatgaatcggcaaaacctgcggcagcggcggcaacgctaaacagaatgagcgaaaatatgatcagccgtcgtgcgccgagataacgcgaaagaaacgcgctaaacggaacgatcagcgttaatcctgcgatataaccgttactcacccatgccagcgccgatatggacgtatgcagatccacggacatcgcaggaaaagccacgctggcaataaacagattaatcagatcaagaaagaagccgagcaggtaaaccactgccactttactgcgatacgtcattatgcatcctccgtcagaggcgctaatgtagccgtccggagaaagccagataagtccgcgcttcaacgatatactgtcaaaataattttgacagtaaaggagctcgccatgctcaatttgcagcgtatgtcgctgtttatcgccgtggtagatagcggcagcttcacggccgccgccgccgcatcgggccaaacaaaagcggtagtgagttttaatattcggcagcttgaaaaagagcttggcgtaacgttactgctacgttccacccgacgattgacgctcacagacgccggcgtcctcttttaccaaaaaggcgtgaatttactcaacgcagcgaaaaatttgcaggatgaagtgcgtgccagccatagtgggctgggcggcgagttacgtattaccactacgcccgagtttggcgaacaggtgatcattccgttactggcgcagtttagtcagcgccatcccgatctccgtattcggcatatgtcctcatcacatcatgccgatttaattgccgagcgctttgatgtggcgattcggcttggctcgctggccgactcccgctatcgcgccgcgctgatatcccgctttaccattctgccggtcgccgcgccgcagtggctcgcccgcaaccccgtgtcgtcgctggagtcgttggctcaggcggaatggattattcatgagcgattacctacgccgctacggtggacagtaacgagtaatcatggccaacactcacgcctggagataagcaaagccggcaaaatttctgtcgacagcgcgcgctcgctgatggccttcgctctcgcgggaagcggcgtcgcattactgccgcaatggttagtcaacaccgcactggaggatggaacgttaattcacgtgttacccgactatcattttccccgtcagggcatttatgccgtttacccggacgcccgccatgtatcgacaaaagtacgcgcatttattgattttttacgttcgcaatgggattgcggggagcacgccccatcatcgtagccagtccgggagcattgcgctcccggacggataatactgtcttaatccttaactaccagcttgtctttgatcccctgcgcctgccaacgcacccacagcataattgccgccagaacaacaatcggcagtaacggatcgagccaactaccgccggaaccgaacagcaggttaatcagcaccacgccggtgccgccaatcgcccaggcaatggtcgtcggtacagaccaaaccaccatctgctgtttgacatcagagacacccatcatgcggttaaccacccagaacaggctatcgttgaagtagccgaagaacagcgaccccatcgttgcggcctgagcggcaagcaacatattgatgccggggatctgcgccaggatcggcgcggaaatcgaggcggcagtgatcatcgccaccgtccccgatccctgaatcaggcgtaccaacgtcgccacgataaacgggatcaggatcggcgagatcggcaggttggcaacctgctccgccagctgttgccccgcgccgctgtcgcgcaggatcgcgcccaacgcgccgccagcgcccgtgaccagtaagataatcccggcgctttgcaagccctcttccagacgctctgcggtggtatgtttatccatgcgcggcaccagcgtatacaccgccagcagaacgctgatggccaacgcgatcaccggacttcccacaaagttgattgcctgtaccaccggatgcgtcgccaggccggaccatccttctacagtggcgagggtggaacagatagccttcaggaagatcagcacgatcggcaccacaataggcagcagagaaagcgtcaggctcggcagttccttttgctctttctctttattgtactgctccagcgcggcattgacttcatcggcgttcagcgtgcgcggcacgaaatcagggtagcgtttatccagccactgcgcatagaacacaatgccgatcacacagggcaccgccagcgccatcccggtcaataacattgcgccgatgtcgacgttaaaaatcccggctacccccagcggaccgggcgtcggaggtaccgtatggtgagtgaccaccagcccgcccgccagcgcgacgcccagcgtcagtagcgaacgcttaccgcttttcgccagcgctttcgccaccggataaagaatgacaaaagcggaatcgacgaaaatggggatgctgacaatataacccgtgatcgccagcgcccactcttcacggcgtttccccagccatttgataaagctccaggcgatacgctccgccgcgccggaaacctccagcaagcgccccatcattacgccgagaccaatcaccaggccaatgctgcccagcgtcgtaccgaatccgctggtgatgacagagagcgttttatcaatgcccattccccccaacagaccggcaatacaggccgccgccagcatcgcgatcagcgcatgaacacgggtgcgtaacaccagccataccagcacgaaaacggcaacgatcagaccgataattggggtcggtaaacttgtcatgacctcccctccatatcatcttgtcgaaagcgttcgataatgtcatcgaagcgtttatcggcgacaaaacctaacgccagcgcacgctggttatcgatacgtcccggccaggaggcaacaattttctcgacgccttcgtcgcgctgatgcgtaacccgatcgcgcgccgcctggccgcccgcctgacacaacgtttccagcatctcgcccacggttacgctgatcccgggtaagttgatgctgctcgcctcgccaggcgcgggtaacgttgcggccagcgacaggttatggatcaccgtcgccgggctggaaatccacagccgcaaactttccgacaccgggcagacggtcgtctcgccctgcaacggttcacgaataatcgcgctgacaaaagaagaagcggcgcggtttggtttacccgggcgaacacagatcgtcggcaaacgcagcgccagcccatccacatagcctttgcgggtatagtcgttgaccaacagttcacaggcggccttctgcgcgccataagacgagcgcggcgtgagcgcggtggtatcggtgacgcattccggcagcgtaccgccataaacggcaagcgagctggagaagacaaaacgaattttctgcggttgtcgacgacacgcctcaagtaactggcgggtaagatccaggttaactttccatcccagatcgaaatcgtcttccgcatgactgctgacaatcgcagcgagatgataaacaacagaggtattagcggtaatcacactctccagcacgcccggctgggttaagtcagcctccaggcagcgtaaacgaggggaatctgataaccgtgcaggcatttttaaatcaacaagaagcagttcgttaaacgccagcgatgagtttaataaggcgcttgcgagtttctggcctaaaaagccgcccccgccggtaatgataatctgcatccggatgtcctctttattgctgtgtagggtagttcagggttagcgccaggcgttaaaccagccaagcccgtcctgagtggtattccgtggttggtattcgcagcctatccagccgcgataacctacgtcatcgaacagccggaacagccatgggtagttgatctcgccatcatccggttcatgtctgtccggtagcgaggcgatttgtacatgggcatagcggcccgcatactcgcgaatcaggtgactcaaattgccatccactttttgcgcgtggaaagtgtcgagctggatgaacacattcgggcggtcaacctcttctgcgatgcccagcgcctgatattggctggaaaagaggtagccgggtttaacgccgggactcagcgcttcgatcaaaatacgtttatcgtgggcggcaaaccggtcggcggcataacgcaaattatcgataaacgtggcgcgataacgtgcgccatcagcgccatccggcacgacgcccgccatgatgtgaacctgctcgcattccagcgccagagcgtattccagagccagatcgatatcggcgcgcgcgtcgtgttcgcgccccggtagcgcggcacgtccccattcgcccgccgcggtatcgcccgccgaagtattaaacagcgccagcgtcagattatgacgcgatagctgggctttaatctcgctggcggcaaagtcataggggaacagaaactcaacggcctgaaaaccggcttcagcagcggcggcaaaacgctcgataaacggcgcttcggtaaacatcatcgacaaattggcggcaaaacgcggcatcgggttatctccttaactgcgcaatttcttcggtggttaaataacgaatcgggcgttcgccaaggataaaaatcagctttgccgtctcttccagctcctcggtattattagcggcttcctgcaaattctccccgcacacgaccggcccatgattagccagtaaaaaggcctgatgccgggccgccagcgcagccaaatcgcgggcaattcggtcatcccccgggcgatagtagggaaccagcggaatgtcgcccatccgcatcaccacatagggggtaaacgggcgaatcacattttgcgggtccagcccttcgagacaggaaagcgccgttgaccaggtgctgtgcagatgtaccacggccttgcagcaagggttattgcgatacaacgccagatgaaaacgcacctctttagacggtttatcgccgctgagccattcgccctgcgggtccactttggatagccgctgcgggtcgagattacccagacacgaaccggtgggcgtcgccagaatattgccgtccggcagtaacagcgagaggttgcctgccgagccggtggcatagccgcgctggaaaaacgaggcggctatcctgaccatctcttctcgcaaagcgtgctcttcttttgccagtatcgtcatacctgaaactccctttgagcgcggatgaaaaaggattcatcgccaaaattacctgactttagcgccagcgagactggcgcatggagcgcgttgacccacggcacgccgggtgaaatgcacggtccgatgtgaaaaccggtaataccgaggctttgcgtcaccacgcccgaggtttcgccgcccgccacaataaaccgggtgataccgccttccgctaagcgagcagccagcagggaaaagagcgcctctaccgcatggctggcttcggtagcgccatattgctgctggatggcggccagcgcctgcgtggaggcggtggcgctaatcattggcgccagttcgctgtcctgactgagcacccactgcgccagcgcttcagcgtaggcctcgcgcgtctcggatgacaggcagcgcgccacatcaacgtcgcgtgtgggagcatgttgtcgatagaaagccacctgctgattcgtcatttgcgaacaggaaccggaaagcaccaccgcgcggccgctcagcggatagcctgcggaacgggcctgagaaacgccgtgcttcgcccactgacgcgccagccccattgccagcccggaaccgccggtcaccagcggagcatcacgcaaaacctcgccctggatttccaggtgccgctcattgagcgcgtcaagtactgcgtagcgatatccttcctgctgtaaacgcgacagcgccgcacgggtcgcggcaacgccttcatcaagcgtctgagctggaataacgccgcagcgcccttgcgcctgcgcttccatcagacgcggcaggtagctgtcggtcatcggattgattgggtggtggcgcataccggactccgccagcaagtggttcatgacaaacagatagccctgataaaccgtgcgtccgttaaccggcagcgcgggagaaatcacggtaaatgaggtatccagcgccaccatcagcgcatcggtgaccgggccgatattgccttcggcggtactatcgaaagtcgagcaatatttgaaatagacttgctggcagccctgttttttcagccataccagcgccgccagcgattgttttatcgcctcttgcgccgggcatgagcgggttttcaggctgataaccaccgcgtcgcacccttccggttgcgtcccggttgggacatcattgatctgcactgtcggcatcccgttttcgaccagaaaactggcgatgtcggtcgcgccggtaaaatcatcggcaatgacgccaatttttaacatgacggctcctcaggcgtgacgccaggcagagtaatccccgagaaaattttgatcacagcgctgtcatcctctttgccataaccggcgttactggcgctggtgaacatatttaacgccgtagaggccagcggtaaggggaagcgcagcgctttcgccgtgtcggcaaccagccccaaatctttgacaaaaatgtcgacggccgaacgcggggtatagtcgccgtcaacgacatgctgcatacggttttcaaacatccaggagttgccggcggcatgggtcacgacgtcatacatcacgtccagaggaataccggcccgcgcggccagcgccatcgcttcggccgccgccgcaatatgcacgccagccagcagttgatgaatgattttgacggttgagcctgcgcccggcgtatcgctgatgcgataaacgttgctggcaacggcgtccagcacaggcttcaggcgggtaaacgccgcctcgctcccggaggccatcaccgtcatttcgccctgcgccgcttttactgcaccgccggaaaccggcgcatccagcatgttaagattcaatgccgtcaacgccgcggcgatctcttgcgcgtcggcgcttgagatcgtggacgaaaccatcaccgcgcttccgggtttcatcagatgggcgacgccatcctcaccgaataacacctgtctgacctgggcggcattgacgaccagaatgactaacgcatccacgacgccggcgaactccctggcgctggcggcagccccacaagccccttcagcgagcagattcgcgcacgcttgcgggttaagatcggccccccatgtggaaagcccggcgcgcaggcatgaacgcgcagcgcccattcccattgagccaagccccacaatgccgacatgaaaatcggttcctgttgtcattatcactccatgttaatttacgtgatattatgttttgttatgtgaatataggcgtttttgtaaacaattgcggtgagttgtttcacaaaaaataacaaaatgtgttattttttgtgaaggcaatcctcatagaacttcacacgctgtgacgagaaatcgcgtaaaatcgcgacaggactaaagaaaggagcagacgttgatacctactgagcgtcgacaaatcattcttgatatggtagcggagaaaggcatcgtcagtatcgctgaactgaccgagcgcatgcatgtatcccacatgactatccgccgtgacttacaaaaactggagcagcaaggcgcggtaatccaggtctctggcggcgtgcaatcatcgactcgcgtggcgcacgaaccctcgcatcagatcaaaaccgaactggcgacgccgcagaaagcggcaattggcaaactggccgccagcctggtacagccagaaagctgtatctaccttgatgcaggtacgaccacgctggcgattgccaggcagctggttacgatgaataaacttacggtggtgacgaatgatttcgttatcgccgattacctgatggacaatagcaattgcacaattattcacactggcggggcggtatgccgggaaaaccggtcgtgcgtcggtgaagccgcggcgacgcttttgcgcgggctgatgattgaccaggcctttatttccgcctcttcctggagcgtgcgcggtatttcaacgccggcagaagataaagtcacggtgaaacgggccgtcgccagcgccagccgccaaaaaattctggtgtgcgacgcgaccaaatacggccaggtcgcgacgtggctggcgttaccgctggcggaattcaaccaaatcgtcaccgatgacggcctgccggaaagcgcaattcgggcgctggccaaagtggatatctcactgctgatggccaaacaatagcgaagcggcgcaagccgcttacgtcatcatcttgcgtaccagttgcgtaaactgttcgcgttcttcagcgctcagtcgccccaaaaactcatcgtcaacgcgatcccccagtggtatcgcggcggtgagcaacgtttggccctgaacggtgagatagacaaaacgccgacgtttatccagcggatcgttttctcgttttaccagcccacgattttccatccggcttaacatctccgccagcgtcgctttagtgctgaccgccgcttcggtcagatcgacctgttcaatacccggatgttcagcaataacgcgcatcaccgcatattgaggtttggtgagctccggtagttcatgctgccagcgtgcggtatgttgctgaaaaagttggcgtaacagatgaaacgcggtgtttcgtaactccatgagcgctccggataaattaactttttctatcataacgacttatgcacggttttttaatgacgaatgctttagctaaacgtgcgcaggcgtcgggagcgatcttgtcgcaaaggccgtgtgggcgtattttgatcaaaatgttcgtatacgaacgatatttgaggtaagaaatgagattgattgtggggatgaccggtgcgaccggcgcgccgcttggcgtcgagctactccaggcattgcgggcgatacctgatgttgaaacgcatctggtaatgtcaaagtgggcgaaaaccactattgaactggagacgccctacacgcccgctgaggtagccgccctggcagattattgtcatagcccggccgatcaggcggcgaccatttcctccggctcatttcgtaccgacggcatgattattatcccctgcagtatgaaaacactggcgggggttcgcgccggctatgccgaggggctggtgggacgcgctgccgatgtcgtgttgaaagagggtcgcaagctggtgcttgtgccgcgggaaatgccgctcagcacgattcatctggaaaacatgcttgcgctttctcgtatgggggtggcgatagtgccgcccatgcccgcgttctacaacctgccgcaaaccgttgacgatattatccagcacatcgtagcgcgcgttctcgaccagtttggtctggagcatacgcgcacgcgccgctggcaaggactgcgacagacagcaaatttttcacaggagaatggataatggcatttgatgatttgcgcagttttttacatgcgctggatcagcagggacaactgctgaaaatcagcgaggaagtgaatgcggagccggatctcgcagccgctgccaacgcaacgggacgcatcggcgatggcgcgcccgcgctgtggtttgacaatattcgtggttttaccgacgcccgcgtggcgatgaataccatcggttcctggcagaaccatgccatctcactgggtttgccgcctaacacgccggttaaaaaacagatcgatgaatttattcgccgctgggacaattttccggtagcgccggaacggcgggcgaatccgggctgggcggaaaataccgtcgacggcgacgcgatcaacctgtttgatatcctgccgctgtttcgtctgaacgacggcgacggcggattctatctggataaagcctgtgtggtatcacgcgatccgctcgatcccgataacttcggcaagcagaatgtcggcatctaccgcatggaagttaaaggcaagcgtaagctgggtctgcaaccagtgccgatgcatgatatcgcattgcacctgcacaaagctgaagagcgcggggaagatctgccgattgcgatcacgttgggtaacgatccgatcattaccctgatgggcgcaacgccgctgaaatacgatcagtcagagtatgaaatggcaggcgcgctgcgtgaaagcccctatcctatcgccaccgcgccgctgaccggttttgatgtgccgtggggatctgaagtcattcttgaaggggtcatcgaaagccgtaaacgtgaaattgaaggaccgttcggcgaatttaccggccactattccggcggtcgcaacatgaccgtggtgcgtatcgataaggtctcttaccgcagcaaacccatttttgaatcgctctatttgggtatgccgtggacggaaatcgactacctgatggggccggcgacctgcgtgccactgtatcaacagctgaaagccgaatttccggaagtgcaggcggtaaacgccatgtacacccacggcttgctggccatcatctcgaccaaaaaacgctacggcggctttgcccgtgcggtgggcctgcgagcgatgacgacgccgcacggtctgggatatgtgaagatggtgatcatggtcgatgaagatgtcgatccattcaatctgccacaggtgatgtgggcgttgtcgtcgaaagtgaatccggcaggcgatctggtacagctaccgaatatgtccgtcctggaactggatccgggctcaagcccggcggggattaccgacaagctgatcattgacgccaccacgccggttgcgccagataaccgtggtcactatagccagccggttgttgatttaccggaaactaaagcctgggctgaaaagctgaccgccatgctggccaaccgtaaataaggagtaaccgatgatttgcccacgctgtgccgatgcacatattgaactcatggcgacttcgccggtaaaaggagtctggacggtatatcagtgtcagcattgtctgtatacctggcgcgataccgaaccgttacgccgtaccagccgcgaacactatccacaagcgtttcgcatgacgcaaaaagatattgatgacgcgccaatggtgccgagtatcccgccgctgctggcagaagacaaacggtaaaaaaaaggccagtcgacagactggcctttttttgacaagggtacttactcgcggaacagcgcttcgatattcagcccctgcgtctgcagaatttcgcgcagacggcgcaggccttcaacctgaatctgacgaacacgttcacgcgtaagaccgatttcacggcctacatcttccagtgtcgcagcttcatatcccagcagaccgaaacggcgcgccagcacttcacgctgtttggcgttcagttcgaacaaccatttgacgatgctctgtttcatatcgtcatcttgcgtggtgtcttccggaccgttctctttttcatcggccaggatgtccagcaacgctttttcggaatcaccgcccagcggggtgtctaccgaggtaatgcgctcgttgagacgaagcatacggctgacgtcatcaaccggtttatccagttgctctgcaatttcttccgcactcggttcgtggtccagtttatgcgacaactcacgtgcggtgcgcaggtatacgttcagctctttaacaatgtgaatcggcaagcgaatcgtacgggtttggttcatgatcgcccgttcgattgtctggcgaatccaccaggttgcgtatgttgagaagcggaacccgcgttccgggtcaaacttctcgactgcacggataagccccaggttgccctcttcaatcaggtccagcaacgccagtccacgattgccataacggcgggcaatttttaccaccagacgcaggttactctcaatcatgcgacggcgagaagcgacatctccacgcagtgcgcgacgcgcaaaatagacttcttcttcggctgttaacagtggtgaatacccaatctcaccaaggtaaagctgagtcgcgtccaacacacgctgtgtggccccttgcgataacagctcttcttcagccaggtcgttatcactgggttactcttcactcaaggctttttcgtcaaaagcctctactccgttctcatcaaattccgcgtcttcatttaaatcatgaactttcagcgtattctgactcaaaaggtggctcctacccgtgatcccttgacggaactagcaagtcaaagcctggttccgccgctttatcgctgcggtaaataacgcagcgggtttacggatttccccttgtaacgaatttcaaaatgcaagcgtgtagagctggtgccggtgctacccatagtagcgattttttgccccgccttaacttcctgttgttcccggaccagcatcgtatcattatgggcgtaggcactcaggtaatcatcgttatgtttgatgataataagattaccgtaaccacgcagtgcgttaccggcatatacgacgcgcccatcagcggttgcgacgatagcctgtcccttactgcctgcaatgtcgatccctttattgcccccttcggaagcgccaaagttttcgatcactttgccatccgtcggccagcgccatgcggaaatcggcgcgctggttgacgtactgcttgcatttggttcggtcgtgcttaccgttggtgccgttacaggcgctgtgacaaccgtcccagcaggcttgttgtttggcaacattttgttagcactttgttcacctgagccctcagaatacgtaattgttggttgagacgcaactgcaacggtggaattttgtgcagacctggtcacaactccttgctgtgctgcatccgcctgggtgatcgcatttccgccagtaattggcgtaccggatgcgttaccaacttgcaaagtttgccctacattcaggctatacggggcagaaatactgtttctctgggccagatcgcggaaatcgttcccggtaatccaggcgatgtaaaaaagcgtatcaccctttttcacggtgtaagtactgccacccgtatagctacctttcggaatattcccatactggcgattgtatacgattcgcccattttccatctgcacgggttgttccgtgaccggttgagtttgcatgggctgcgttacaggacgctgaacgggttgaatttgcggcgcttgttgcggcgtttgttgcgtcgtcgcgcccatttttggcggcggtgtgatcaacatcccggaattggtatttgatgacgaaccactgtccacagacgtgaccggcgccggagggtttgacgaactggtacaacctgccagccatagtgaaaccagtgatagtgccgcaatgcgactaacggtgaattttgggcttcccgcgctcatttatcccccaggaaaaaatttggttaacaaccagtgacgtaagaaccgtgcaacgcattaagtgaacacgggaaaatgtgttcacgatacgcttaacccaccgggaataaccaggaaaactccaggtattcgtttcggcttcatcaggcgtaagagtgggtgtttgcagggcaaactaggccagctctcccttgactaacgggacgaagcgaacggcctccacggtatcgataataaattcgccgccccggcgacgcacgcgtttcaaaaactgctgctcatcgcccacgggcagaacaagaatgccgccttcatccaactgtgccatgagcgcggtaggaatttccggcggcgcggccgtcacaatgatagcgtcaaatggcgcacgcgcctgccagccttgccagccatcgccatgacgggtagaaacattatgtaaatcgagctgcttcaggcggcgacgcgcctgccattgcagccccttaatccgctcaacggagcaaacgtgatgtaccagatgcgccagaatcgccgtctgatagccggaaccggtaccaatttccagcaccctggattgcggcgtcagttcgagcagctccgtcattcgcgccaccatatagggctgcgaaatcgtctgaccctggcctatcggcaaagcgatattttcccaggccttatgttcaaacgcttcatcaataaatttctcgcgcggcactgcagcaagcgcattaagcacctgctcatctctgatgccctgcgcgcgcaattgttcaagaagagcctgtacacgtccacttaccattgcgtgccaactcccacgctgtctaaccagtctgaaaccacatcatgcgcgctgtgcgcggttaaatccacatgcaacggcgtgacggagacgtagccttcatccaccgccgcgaaatcggtatccggcccggcatcgtatttatcgcccggcgggccaatccagtacaatgtattaccgcgcggatcttcctgcgggattactttatccgctggatggcggctaccacagcgagtcacgcgaatgcctttaacctgcgctaacggtagatccgggacattcacgttgagaatacgcccggtacgcaacggctcccggcttaaccctcgcaaaagcgcgcaagtcacggccgcagccgtatcataatgctgatagccgttaagggagaccgctaatgccggaaagccgagatgacgaccttccatcgccgcggcgacagtaccggaatagatcacatcatcgcccagattcggacccgcgttaataccggaaacgacaatatccggacgcggacgcattaaggcattaacgcccagatagacgcaatcggtcggcgtccccatctgtacagcgatatcgccattatcaaaggtaaaagtacgaagcgaagattccagcgtgagggaattagacgcgccgctgcggttacgatccggggctacgacctgtacatcagcaaactcacgcagcgctttcgccagcgtttgtataccgggcgcgtgaaccccgtcatcgttactcagcaatatgcgcataatcacccattgtgttgatcagttcccttactacgctggtggcaaaactgcctgcgggcagccagaaacgtaactcgacggtaacgtcatcccaccagttccagcttaattgttgcggataaagcagcatcgctctgcgcgacgcctctactttttcgcgcagcaacagcgattgcaacaccgtttcctgggcaatggcatcttgctcaaacgccagcgccgcacgctgtgttccccactctccgctgcccggcaacgacgctgtaatcatcagctctttttcgtctacccggcgctgcaattcaggcagttcttcagatgtcgcgacgaaccagcttccacgccccgctaattgtagcgcatcgccgtcaacaacttgattaaagtctggtttcttcagccgctggtgaacaatttgattaaacaacgcgctacgcgccgccgacaaccaaaaactgcgtttattgcgatcgcgcaccggcgcgttactttgcgcccagcgcagcgcgccctgcaagttgctgccgccaatgccgaatcgttgtgcaccaaaatagttcggcacgccgccatcgcgaatcgcctgcaatcgtgtttcgacatcgcggcgatcgcttatttcacgcaacaccagagtaaaggcattgcctttcagcgcgcctaaacgcagcttacgcttgtgacgcgcgtattccagcactttacaaccttccaactgaaaggcgctgaaatcgggcatctctttccccggcacgcgcgcgcacagccactgctcggtaacggcgtgtttatctttttgcccggcaaagctcacttcgcgagcgtgaattttcaggaatttcgccagcgcgtcagcgacaaaacgggtattgcaaccgtttttcaaaatacgcagcaaaatgtgctcgccttcaccatccggcgtaaagcctaaatcttcaaccaccacaaaatcttccggattcgctttcagcaatccgctaccttgtggttttccgtgcagccaggtgagattgtcaaactctgtcatttcgccgccttcatcagcaacgcgaccgcttcgcaggcaatgccttctccgcgtccggtaaatccgagcttttccgtcgtcgtcgccttcacgttaacctcatccatatggcagccgagatcttcggcgataaagacgcgcatttgcggaatatgcggcagcattttcggcgcctgcgcaataatggtgacatccacgttgccgagggtgtaccccttcgcctgaatacgacgccaggcttcacgcagtagttcgcggctatccgctcccttaaatgccggatcggtatccgggaagagcttgccgatatcgccaagcgccgccgcgcccagcagcgcatcggtcagcgcatgtaacgccacatcgccatcggaatgcgccaatagccctttttcataagggatacgcacgccgccaataataatcggcccttctccgccaaacgcgtgtacgtcaaaaccgtgtccaattcgcattatgctttctcctggtggatggttcgggtcagataaaattccgccagcgccagatcttccggacgggtgaccttgatattatccgcgcgaccttctaccagcgccggatgaaaaccacaatattccagcgctgacgcttcgtcggtgatggtcgcgccttcattcagcgcacgcgtcagacaatcgtacaagagttcgcgggggaaaaactgcggggtgagcgcgtgccataaatcggcgcgctctacggtatgggcaatagcgttcttccccggttcgccgcgtttcatggtgtcgcgcaccggactggcgaggataccgccgacccggctgttttcgctgatagccagcaaccgcgcaaggtcatcctgatgcaaacagggtcttgccgcgtcgtgcaccagcacccactgcgcctttgcaacggcctgtaacccggccaaaacggaatcagcgcgttcgttgccgccatccacaacggtgatttgcggatgattcgccagcggaagttgggcaaagcgatgatcgccagggctgatagcaataacaacgcgtgtcacccgaggatgcgccagcagcgcatgaactgagtgctccagaatggttttattaccgattgagagatactgcttaggacattctgtttgcattcggcggccaaatccggccgccggcaccacggcgcaaacgtccaataaagtggctgccatgttaaatccctggatggtttatcgatgagtttgccccgccgttgccgcgcgttttgaggcgtcaggcaccagacgatagaaggtttcgcccggtttggtcatgctaagttcgttgcgcgcgcgctcctctatcgcttcctggccgccattgagatcgtcaatttcggcaaaaagctgatcgttacgcgctttaagtttggcgtttgtcgcctgctgcgcgaccacatcatcgttgacgcggctatagtcatgtatgccgttcttaccgaaccacagcgagtactgtagccagaccagtaaagccagcaacagcagcgttagtttacccatcctgccccctgaaaaacggcatcatcatcccataacgtcctctgtgactccacattcaggacgggattgccgcgacaacgccggcaaatgtaccacatttgccggatgttacgtatacccgagtaaggagaacataatctcattgttggttacggtttgaattatgaccggaggcgcagtgataacccgtctaccctaatagccatataaataacgcgccgaacagcgcgcctacggccagtagagtaaacatgatgctaaaaagtattttgccctttaccagcagatgcaacgcaatgccgataatcaccgataccggcattaacgcgaggaaaaagggccaggtatagaggaaaaaaaacagcgtgttagggccataaagcagaaaagggatccccaacgccagcagccatgacacaaagccgaccaccgcccccggaaatgcactggtggcgtcatcgtcgaccatgaaggcgtctgaccttgtgaaagtaatgttatggctattacgcatattaaatcctgtaaccttgaccataccgggcatacaagcccggtggtgtctcaggatctgataatatcgcgccgtctcagcaggtctaataattgggaaaccaaatttgttactaattgttcaccattaagatgaacctgtggcgagtcaggcgcttcgtaaatggcgtcgatgccggtaaagttacgcaactcgcccgcacgcgcttttttatacaaccctttaggatcgcgctgttcacagatagccagcggcgtattgacataaatctcgataaaacgatcgtggccgacgcgctcttttaccagttgccgctcggcgcggtgcggagaaataaatgccgtcaaaacaatcaggccggcgtccgccatcaggctggccacttcgcctacccgccggatattctcctggcgatcggcatcgctaaagcctaaatcacggcacaaaccgtggcgcacattatcaccatccaacaggtaggtactgacgccacgctgatgtaacgcctcttccagcgcgccggccaccgttgattttcccgaaccggagagtccggtaaaccacagcaccacgccacggtggccgtggagctgttcacgggcggcgacagtaacgggatgagagtgccagaccacgttctcatcatgcagcgccatgtttatctcccagcaaatctcgggcgtcccagtgcggaaaatgacggcgtaccagcgcattcagctccagctcaaacgcactgtattccacgggcggcgtcgctccgcgttcatccagttcccgcaccatgccagcgcccacggtaacgttagaaagtcggtcgataaaaatcagcccgcccgtcaccggattttgctgataaatatccagcgcgagcggctcatcgaatgtcatctccaccagaccaataccgtttaacggcagactttcgacgtctcgttgggtcagattgttgatatcaatctgatagcgaatagcctcgatacgcgcgcgggttttcttacccgcaagtttaacgtcgtagctttggcccggcgccagcggctgttccgccatccataccacgtcgatcgcagcgtgccgcgcaggtgccagcgtctcgtttgccgccagcagcagatcgccgcggctaatatcaatgtcgtcgttgagtaccagggtaatggcttcgcccgcacaggcttcttctttgtcgccatcaaaagtaacgatacgcgccacgctggattccacgccggacggcagcactttaatgcgctctccgactttgacgctaccagacgccagagtgccggcatacccccgaaaatcaagatttgggcgattaacgtattgtactggaaagcgcatcggttgacggtctaccgcacgctgtatgtctaccgtttccaggacttccaacagcgtcgggccgctgtaccagcgcatattggcgctctgcgcggcgacattatccccttccagcgccgaaagcgggacaaagcgaatgtccagatcgcccggcaactgttcagcaaaggtcaggtaatcttcacgaatacgggcgaaggtctcttcgcggtagtcaacgagatccattttgttgattgccaccaccaggtgtttgatccccaacagagtggagataaagctatggcgacgcgtctgatccagcacgcctttacgcgcgtcgatcagtaggatcgccagatcgcaggtggacgccccggtcgccatattacgagtatattgttcatggcccggcgtgtcggcgataataaattttcgtctttccgtggagaaatagcggtacgcgacgtcaatagtaatgccctgctcacgctcggcctgtagcccatctaccagcagcgccagatcgagtttttctccctgcgtgccatgacgtttactgtcattatgcagagaagagagctgatcttcataaatttgcagagtatcgtgcagcaaacgacctatcagcgtacttttaccgtcatcaacgctgccacaggttaaaaaacgcagcaggcttttgtgctgttgggcaatcatccaggcttcgacgccgccttcattggcgatttgttgtgcaagtatggtgttcatggcggctccttagaaatacccctgacgttttttaagctccatcgaccccgcctgatcgcggtcaatcatcctcccctggcgctcgctggtggtagaaaccagcatctcttcgataatttccggcagcgtttgcgcgtgggattccaccgccccggtgagcggccaacagccaagtgtacggaagcgcaccatcctttttttgatgacttcgccaggctggagatcgatacgatcgtcatccaccatcatcaacatgccgtcacgttccagaaccgggcgttcagcagccaaatacagcggcacgatgtcgatgttttccagccagatgtattgccagatatcctgctctgtccagttggagagcgggaagacgcgtatactttcgcctttattaatctgaccgttatagttacgccacaactctggccgctgatttttcgggtcccagcgatggaaacggtcacgaaaggagtaaatacgttctttcgcacgggatttttcctcatcgcgccgtgcgccgccgaacgcggcatcaaaaccgtacttattcagcgcctgctttaacccttcggttttcataatgtcggtgtgtttagcgctaccgtgaacgaacggattgatgcccatcgccacgccttccggatttttatgtaccagcaattcgcagccgtatgcgttggcggtacgatcgcgaaaggcgtacatctcacggaatttccaaccggtatcaacgtgcaatagcgggaacggcaacgtacccggataaaacgccttacgcgccagatgcagcatgacgctggagtctttaccaatggagtacagcatgaccggattagcgaattccgctgccacttcacggataatgtggatactttccgcctccagttgccgcaggtgggtgagtcgtttttgatccataaccgttcctttgcaataccgttttttgctaaacatttcgattacacgactatagggagcgcaggagagtgaatgaaatgacgaattggaatgagtagttcctcaaaggaataacgcggcccaaaaaccaatatcaaaaaatgcttaacgtaccggattgccagcatttaggagcaaatgaaattgtattaacacgatcgcggtttcatactagccacgtaaaattttgttctgtatttaaggactcattatgttttccgcaacgcgccgctttgccgtcattctggcgctcggcgtaggctttatccttcctgcacaagcagcatcaccagggcctggtgaaatagcgaatactcaggcacgacatatcgccaccttttttcccgggagaatgacgggctcccccgccgagatgttgtctgccgattatttacgccaacaatttacccagatgggataccaaagcgatattcgaacgtttaatagccgatttatttataccacgaaggataatcgcaaaaactggcataacgtgacgggcagtacggtcatcgccgcccatgaagggcgcgtgccgcaacagatcatcattatggcgcatctggatacgtacgctccgcagagcgacgctgatgtcgatgccaatctgggcggtttaacgttacagggaatggatgataatgccgcgggattaggcgttatgctggaactggcggcgcgtctgaaagatataccgacccattacgggattcgttttatcgccaccagcggggaagaagagggaaagctaggcgcggaaaatttactcaaacgaatgagtgacgctgagaagaaaaatacgctgctggtcattaatctcgataacctgattgttggcgacaagctctattttaatagcgggaaaaatacgccggaagcggtgcgtacactgacccgcgatcgggcattagcgattgcgcgccgttatggcatcgccgccaacaccaatccgggacgcaatccatcctaccccaaaggaacgggttgctgtaatgatgcggaggttttcgataaagcgggaatatctgtgctttctgttgaggcgacgaactggaatctgggtaaaaaagacggataccagcaacgcgtgaaaaatgcctccttcccgaacggtaatagctggcacgacgtacggcttgataatcaacagcatattgacaaggcgctgccagggcggattgagcgccgtagccgcgatgtagtgcggataatgctgccgttggtaaaagagctggcgaaggcggaaaaaacgtcctgatatgctggtgaaacgtgtttatccccgctggcgcggggaacatttttcagcccttgtcgactgcggaacgcccctcggtttatccccgctggcgcggggaacacgcgaaatagtggggaaaaacccctggttaacccggtttatccccgctggcgcgggaaacactaggccttgataccatcgctcgcacctcgtcacggtttatccccgctggcgcggggaacactcttttgattttgctgcgatgttataaccagacggtttatccccgctggcgcggggaacactatccacatatacccgcaatcatattcaagaacggtttatccccgctggcgcggggaacacaatcactgcgggggtatttagcggaaacggctcggtttatccccgctggcgcggggaacacgatcgagtaacgtgcgctggaacgcgtcggcgcggggaacacaattaaagccgagggtggcaccgcgccttattcggtttatccccgctggcgcggggaacacgcacctcgaaacggttttaaaacactaccgtttcggtttatccccgctggcgcggggaacactggaccgatggggccaacatcgccgaacgtggcggtttatccccgctggcgcggggaacacgttacgttcggtaaatggaaagcggcgaatatcggtttatccccgctggcgcggggaacacccagaaagtgccggtagtgcctgatgaacgaccggtttatccccgctggcgcggggaacaccgcgcccacttccgtaaaatacagataatccacggtttatccccgctggcgcggggaacacggtaatttctcatctaacagcctgtacgcctcaggtttatccccgctggcgcggggaacacgaatctaatgcaacagatgaataaacacgtaacggtttatccccgctggcgcggggaacactctttatcgtcaatgcgaaattttccgcgacgcggtttatccccgctggcgcggggaacactcccattcaccaacaacaatatcgccctgcaacggtttatccccgctggcgcggggaacaccgttgcgtcaggttgatccagtgcgtcagcggcggtttatccccgctggcgcggggaacactctcggtctcggtctcggtctcggtagtgacgcggtttatccccgctggcgcggggaacacacttccttcagtcttaacgataatccgcaacgcggtttatccccgctggcgcggggaacacgcaaaatagcgatgagctggctacgcccactggcggtttatccccgctggcgcggggaacacgaggggataggagttacgatccagcctggttgcggtttatccccgctggcgcggggaacacgtggttgcagaccaatcagcccgccagcggttcggtttatccccgctggcgcggggaacacgtggttgcagaccaatcagcccgccagcggttcggtttatccccgctggcgcggggaacaccagcacgaaaaattatttactgtcgttgctcacggtttatccccgctggcgcggggaacacactaaaactatatatttgttctaaaagcccttttttactacataacaaactaccaacggtaagataacaattccttattattaaagaacattcaacttattgattttcaacaggaagaaaagaaaccaaacgcagtccatccaaatctaccggaatacgtctgttttcaccccaggtctggaactcaaaaccagactcagtatttgttgcccaggccattactacgtttccgactccgccaagctgtgtgatctgttgccaaatcatttcccgaatacgcttcgaggtatcgccaacataaacacctgcacgaacctcgagtaaccagacggcaagacgtccccgcaggcgcggcggtacgttttccgtgaccacaaccaccatactcatcaaccatgcccccgatggccgctatcacccagtgattcaggttccggtattgctggcggcaacatatccggcgcaggctgaggtggttcaatttcaccggcagcgagcacctcttcgatcagtgggatcaattttccggtcagcttcgaactgcgaaaaatatcacggcaggccaggcgcacttctttatcaggttccgccgggtgacgagcagcgatctcaaatgctttgggcaccaccgattcaaatttgatgatatcggcaatgtcataaacaaaagaaagcggcttaccactatggataaaaccgatagctggcgcatatcccgccgccaggatagccgcttctgaaatcccgtacaggcacgatgtcgccgcgctaatacatcggttgacgacatcccccttctcccagtctttcggatcatagttacgaccatgccacttcacgccatactgcttcgccagcaatgcataggtcgcccgcacacgggatccttcaataccgcgcagttgctcaacggaacgacgggcgggcggcggttcgcgaaaacgcagttcatacattttgcgcaccaccttcagccgcaggtcatcatctaacgccagctttgcctgataaagcaacttatcggctcgtgcgccgccgggttgtccggaggaataaacccgcactcccgcctcgcccacccacaccaacagcgttcccaccgtcgatgccagacgcacagccgcatgggaaacccgcgttcccggttccagcatgatacaagcgaccgaaccaacgggaatatgcgtgcggattcccgttttatcgatcagcacgaatgccccatccagcacgtcaatctgaccgtactggaggaagatcattgaggttcgatcttttaacgggatcgggttgagcggcacgaacgtcacgcgtcgtctccaggtttgatcatcatcattccgcagccaaacgcccggcttttaccgaacccctgcgccagacgttgcaggaaaagcgcgggttcgttaatcaccagcacgccggtatagtccacgctgctaaactgaatcatctgccgatctttcccgcgacgtatctgctgctgccgataagcatcaacgctcgcctcgcgcagagtaaagccattttgctccccctggcgcgccaaccacgtcagcgccgcctgctgctgataagaccaaatatcctggctatcaccctgcgttttacgctggcgtttcgcctccatcagcaaatcgtgacgcttgccgtttttgcaaaccgtcggattggcgcgcaggttaaaccgcagcgtctgccccgcgctcagcgttggcgcaaatgggcgagtctgcacgtcaaaaatcgcgctggcggcaggctgttcctgtgagagaacaaaaaagcgaaacgcgccctgtaactcttcgcggcgataaagaaactgccgttccttgctgccgggaaagagatcccataaccactggtgcatcacgtactcgccgcgctccaccagatgcaagagctgtgccggcgaaagctcgctggtgtgcagcgttattcttgagagatacacgcgtcctccttgcggagccacggcccctgattcacgctacgttcaccgaacagccattgctggcggctcaacggcatgtcgcgacgacgtaaaattttgctcgccgttaagccatcgtgttcaccttcccaccagcattcgttctgtaatctggggagaggcagtttcagcgcattgaattgatcctgataccaacgatatgcttcacgcaggacacccgccgcactcccttccagcagttgcggcgcaagcggcaacgccagagggtgacttttgcgccccagatacagcgggaatacaggatgttgtagcgacgtctgaagctgcgccaacgtgtaaggcgcgtccggcgtcgcgctgacagcgatcatccaccaggcgtcggtgtagtagtcgcgtcgggaaatcagcgcgctcagtaattcaggatcctgcaactcttcacggcggctgaagtaacgtgccttacgtacctctttcggcatctgcaccgtgtgataatcccgcgcccagcgcgggttgccactggcgcacagcaaaaattggtaatgacgattgaaggcgtttagccgttcctcctcatcgcggcgaattcccagcgccgcagctaataaccccaacagcgccgagcgcgagggtagctcatggctgtggcgcacttcgcctggcgcatccacgccccaggaggccatcggcccgtgaagctgaaaaaccagatattggctcataagccgccccttacgcgcagatgaagtcaagcacgtcttccatgcttccctgctgattcatcacgtcgaaactggcggtatcagtccgctggccataaaccttattcatattcttatgcagcgatgtaatacgcttaaccgcaacgttcaattggtctgtaccgttgatcggttcataaaacgcggccgccagtgaacgtggttggtcggtgcctttttcggccagcgcccacgaggcataggcacggctggcaaagctgttctgtttgccggtcggcgacactttcagcgccgcttcagtaaaggcgcgcagcgttttgtttgccagttcttcattgtcgttcaggtttttcaccagcagatctttgtcgatgcagatataggtgtaaaacagcgcggagccaaagccggtttcgccgagatggcctgcgcctgcatcttctgccgatgcctggcgtaggtcatccacagcggtaaagaaatcgtcttcgatgatcgtttcgctgacgccgaaggcgtgggcgacctggcaggcggcttccacgttaaaatcagttttcttcgctaacatccggccaaacatggcaatatcgacggccatgcgatcgtgacgtaacagttctgcttcctcttctgttgccggacgtttttcttctgccagacggcgcgccagcgctttcacggcctcaaactcagcagggctgatatgcaccagttgctcggtttcagcattcgtcaactcatctttgggtttcttatcctcttttaccttgccaaagcagttggcgatgttcttgacgtactcaaccgcttttttggcgtcaatgccgctatcaacgaggatttgcgccgcctcacgagcaatgcgaccagtacgaataccaatatggccagctaatgcctgttcaaataactcagatgtacgccaggcgcgtttcaggctctgagaggagatacgcagacgtgttgctccgccaagcaccacggtttttggcgcaccggtatcatcacggttcaggttagcggcggggtaagcggtcagtaaatggagctgaataaacgttgtcataaagatatccctgttaatcttgttcgttatcggtatcgccatcgccggcctggtagtattccagcgcccagcggatacgaagaaattcggttggccgctgctggcggcgatggtggttcagcaagtcattctgctcctggcaccagcagaaaatatcgtctgcaagagaaaacaggttgaccgaaccatctaacagcttcaccgcacgccgtaactggcgcagcagttcatccggcgtttttaccgctaataggtgggagaagcgtaattttgacatcaccggagtgtcgccacctttcttctgtccaagctgcgcagcaaaactcttttgctcatcaataaatttgatatgtgcagccagtgccgctgtgattgccaatgcagtaacattccagggtgctttgtttttccataaagaatgtgtttgcattaacaatgaatgaagcccctcagccaaacaggcatcattcaccgttttactacgtcgtaagctggcacgtaatccacgtttttcttgtagttcctcatgccactgacgcaaagtggctttatcatctttcgtcacaacactcattcagcagcctcctgtttctttgctttggcggcttttgcactttgtttttccgccgatgtcgtaaaatatttcttgcgcgcggtcatgatgcgttccagatcgctgctctcgtaggggttggtaaagacgtgatcatcgaagtaatgacgggtaaacagccaaagttctctttgccatttattcagcctttcgtccggcttgtggccgttttccagatcgtgaatcaggttgagaaaacgtccctgcgtcaggttccagaaatcaatgtcgataaaactgaaatcaccgcgagcacccttcgcatcggcaaaccaggcctctttgagcgcgctgcgaagcaggctcaacaggcgggccgcagtttgcacggccttacgtaaatcagggatcagaccttccgtcatcagcaacgggaagtgatgctcataccagcagcggattttcatattgtcgaaatccgcgccaaagccccagatccccgctttaacgtcagtcagcgagcgggcgttaaacaccttgactacctgcgcgggagattcgtaattcgcttccgtctggttgttctgacttaatcccagccagtcgcgccagataaggccgccgggctgcggtttaacggaaaagaaggcgttttgatcttttaccggggcgcgataaggcgtcagcgggtgccgccagccatcgtagttaacgccgtagttcttgacggtcataaagccaagaagctcatcgctttcagcgccgcaaatatcgcagcaacctgactgtaaggtggcaaaatccaggcggatacgacgcggcatcccccagtacgcctggagtttattgacctgctccggcgtggtaacggcattcgcctgctcgctggtccgcgtcgcggcaagccacgggaaaacggtcgcatcacactggtctggtaaaggcagatccgcagtatcctgcggcatcacgttgagccacagcttgcgccagagcggcgtttgccgctcgccctgatattcctgcaattcaaccagcgtggtcagtggcccgccgccgcgcagcccggtacgatagcctttgccgcccgcaggcgcgttaagctgcaacgagaacagcgccagcgccgcgcagtgcggacaaaaacgttccgttacgccgcgtttgacaaaatgatctttattgaacttcgtggtttgcgcgccaggtatttccggcaacaatgaggcaatagagactttttcgccgcttaacggttcaaaatcctgcataaaagacggcgtttccgcgccaaactgaaaagcgtgttctaacggtgctaatgccttatggagcacatcggcatgcaatccatcaaaccagatatcctcccaatttttgtatcttttcggcgcgatactgcattgcagcaatcccaacagaaactgccaagccgctccctgtaaatctgctcgcgttgcggcgatgtccaccacgttttcatccgccagatcgacgggggccagcttgcccgtggaaccgtctttgaaacggacggggagccagggcgttgttaaaagtgaaaaattgtccatatctgtattcgttattcccccatcatgccaatcaatccctcattcgccgaataaccacaagcggcaaagtccgtcaccacaatcaccgtggcaaaatccttatcctgatgctgttgcgcacaccacttacgcaagggttcgccgtctaatttttcaaactcgtctttatgtttattccaccagctctgacgtactcgcagcacgctcatctcccaggcgtgttcaccgctggcataaggggttacgacgctatccacgattttcgccagccacagcgtgacagactcttccgccagccgcgttgacattttctccggtaaagaatcgctaatttcagcacagtagcccggcgcaaagttaagcagcatctggccggcaaatgcccggtcgcaataaaatttgccttcctgcaattgctcggtttttgcaaatccaaccggcatgttgacatcctcgccgtagaccgactcaatcaacaatcgggcagattgcggcatccgaatcgtcccctgctcacgtaatatgcgctgtgtcagccacatgcgcccatgatcgggatagacataggcgctgttacgcatggcgctggataaccagttctctcgcggcgcgtcatcccactccggagcaagaatgcgcagcactggcgtctctcgctcatcctgcccactctttttcaccagaccgttacgatcgcgaatatgacgctgtagtcgaccggcccgctgaattaataaatccaccggcgctaaatcagagatcatctcatcgcagtcaatatccagactttgttcgatgacctgcgtggcgataatgaccttaccggcacgttgcgcgccgctctgtttgccaaagagattcagcgtctgtgactcaatccgctgacgatcgtaaaaagcaaagcgactatggaagagtaaaaggttttccgtgacgacgaccttactcagttgaagctggcgatagatacgaatcgcatcatcaacggagttacgtatccaggcgatacagtttcctttttccactgcttcacctatacgttcaagacacgcctcttcactatgtagccagccaatatctacgcaacgctcaacctctttgcgtgtatcaacccgctgagaaatcagctctgtttgtgtgacctgagtcagccagggataatcgtcatggcctagcaacggcgcctgcacactacgcctcaccccacgggaaaatgccgccaccagcttatctcgctgctgctgcgatagcgtcgcagataacagaatagtggcgttgccattactggcctgccgttcgatcaaaccttcaagtattcgggacatccaggcatcacaggcatggatctcatcagccagtaagatcttgttgctaagacccagtaaccgcaggttgttatgtttaaatggcattaccgccatcatcgcctgatccaacgtgcctacgccaacctccgccaacaacgcttttttattgctgtcggcaaaccaggcggcgcatccctgactataaggctgcgcttcatcgggttcttccgtaccagaaagagtgaccgaccatattgactgattgaaacgatccattaagcgacgcgcgctatgcgccagaatcaggctgggacgggagtccggctgatacagcgccagccaggtgttcgccatacgttcaaacatcgcgttggctgtcgccattgtcggcagtccaaaatagagtccctgcgctttacctgccgccatcagtcgatgagctaatatgagcgccgcctctgtttttccggccccggtgacatcttcaagaataaagagttgggcgccatccacgttgatatccagctcaagcgccttttgttgtaacggtgtgggatgctgaataaaagggaaaagcgtttctatgcccgtaaaggcagacacattcgccgctgagggaaatagcgtgatggcagtttgtgctttagcgagagcttgctgccagtaggtatcaacaggcattttttccgcagtacgcggaaaataacggctggcagaaccagtccagtcagccagtacaaccgcagcggaaataaaccaggaaagttgctgaaattggtcgataccctcatcttcatcccaggcttcaggcaaagtaattaaaggaaagagcgcttttattctcagaagaaaatctcttgccgcgtctttatcctgctggcgaaaatggtccagctcctggattgcctctggagggcgtccatgatgacctgtagtgactggcatccaaagcgccataacgcgcttacttttacgaactgaaagcgaagaaggaggaaacaattcagggcattcacttagccaggagttccacaacatgtatcccagcgtggtatgcgcgattttttcataatgccgtgtaggctcattaaagatatttaaagcctcatgacggtatagttgctggaaggaatgagcaaactttccaatatcatgccaacataaaatccaggcaaaaaattgcgccgcctgctccttatcctggatgcctaatttttttagatagtggtcaataaaataaatattatttatcaccatccagtaacccacagccgcaacatctaaagaatgccagcaaagcaaatggtaatcatcaccgccgtcagtttctcctcgtcgagactttccccaatagtgatatatcgacacgtaaactccagcatgtggataataaaagcactctacgcctttttaatggtcttttttgttgatatacctcacaaaaattgcacttcctgagattatatttaaatatgcccgctcaattttatatattcttcagaaatatttaccccacgaataattattataaatttttccgcctttttcttctggaagaagcgctcaaagaggcttcctccaatgccttctgcataaaccaaaatttaaaaaaaacgaccatttgcggcgaatcatctaccttttgtctgaattatcgtcaccacaaaggattaccaaccataaatgtgctgtattaataatgtcgttcaaattctctcctgtagtaaactttatctgtttaataaaaaagagagaattgaacgatatattttactccggatattgaataatataaatttgaaggaaaatattatgccagtcactttaagcttcggtaatcatcaaaattatacgcttaatgaaagtcggcttgctcatctgttaagcgcagataaagaaaaagcaatccatatggggggttgggataaagtccaggatcattttagagcggaaaaaaaggaccatgcgctggaagtgttacactccatcattcacgggcagggccgtggtgaacctggagagatggaagttaacgtagaggatataaataaaatttacgcctttaaacggctacaacatctggcctgcccggctcatcaagatctgtttactatcaagatggacgcttctcagacacaatttttacttatggtcggcgacacggtgatcagccaaagcaatattaaggacatccttaatatatcagatgatgcagtgatagaatctatgagtagagaggagagacaattatttttacaaatatgtgaggtgattggttcgaagatgacctggcacccggaattacttcaggagtcgatttcaactctacgaaaagaagtgacgggaaatgcacaaatcaaaacggcggtttatgagatgatgcgtcccgcagaggctccagaccacccgcttgtcgaatggcaggactcacttactgcagatgaaaaatcaatgctggcctgtattaatgccggtaactttgagcctacgactcagttttgcaaaataggttatcaggaggtacaaggtgaagtcgcttttagcatgatgcatccgtgcatctcctatttactacatagctattcaccgttttcagagtttaaaccaacaaattctggttttttaaaaaaacttaatcaggattataacgactatcatgcaaaaaaaatgtttattgatgtaattcttgaaaaactatatctaacccatgaacgttctttgcacattggtaaagatgggtgcagtcgtaatatattactgacataaagatagtcagtaatataaccaatttaaaatccggctgcctgccggatttttcatagcagcaagtataatcataccgcgtaaggacaattacccttcatgcagcccgcactcgcgcttcagcccgaagaagcgtgtctcttcttccgccatacccggctcccatttgcgggtggtgtgcgtatcgcccaccgacagatagccctgatcccacagcggatggtatttcaggccatgcttttgcaggtactggtaaacggtgcgattatcccagtcgataatcggtagcactttaaacacgccgcgctggatagcgagaacgggtaaatgcgcgcggctgccggactgctcgcgacgcagacccgcaaaccacgtctgcgctttcagctcttttagcgcccggttcatcggctcgactttgttgatctcattgtatttctcaatgccctcaacgccctgctcccacagcttgccgtagcgcgcttcctgccaggccggactttcgcccgcgcggtaaactttcaggttgagtttgagtttgtccgttagctcatcaataaactggtaggtttccgggaacaaatagccggtatcggtgaggatcaccgggatatccgggcgaatctggttcaccaggtgcaggctcaccgccgcctggatgccaaagcttgaggagagcacgtattcgccgggcagattttccagcgcccaggccacgcgttcttcggcgctcagtttttccagttgggcgttggtttccgccagagccattacgcgatcgacttttggcaattcattcaatgcgttgagatcgagttgggacatgagttcctcactgtttgccttgcctgatggcgctgtgcttatcaggcctacacagacgccatccggcaattcaggttattcccagaaatcacgcgcgggatcgagcaccgggcgaatgatgcccgcacgcaccgtaaagtcgccgaagccttcacccgcttcacgctctttcgcccagcgcccaatcagttcatccagcgaggccagaatatccggctcggcgatattttctttatacatccgtgggatacgactcccgatgcggttgccaccaagatgcaggttataacgaccaggcgctttccctactaagccaatttccgccagcatcgcgcggccacagccgttcgggcagccggtcacgcgcatcacgatatgctcatcaggaatgccgtgtttttccagaatcgcttccactttgtccgtgaacgacggcaggaaacgctcggcttccgccattgccagcgggcaggttgggaacgacacgcaggccattgagttttcacgctgcggtttcaccgcattcatcaacccgtggtcgcgcgccagcgtctcgatcttcgctttctggctttccggcacgctggcaataatcaggttctggttagcggtgatacggaactcgccctgatgaatcttcgcgatctccagcaggccggttttcagcggacgccccggataatccaggatacggccgttctcaataaacagcgtcaggtgccatttatcatcaatgcctttcacccagccaatcctgtcgccacgcccggtaaactcatacgggcggatcggctcaaatttgatccccgcgcgacgctcgacttccgctttaaatgtctccagtcccacgcgctcaagggtgtatttggttttggcatttttcctgtcggtacggttaccccagtcgcgctgcgtcgtcactaccgcttcggccaccgccagggtgtgctccagcggcagatagccaaactcgctggccgtacgagcgtaggttttcttattaccatgctcaatagacagaccgccgcccaccagcaggttaaagccgaccagcttgccgttctcggcaatcgccacaaagttcatgtcgttggcgtgcagatcgatatcattttgcggcgggatcaccaccgtggttttaaatttacgcggcagataggtctgcccgaggatcggttcttcatcggtggtcgcgaccttctcctgatcgagccagatctccgcatacgcacgggtgcgcggcagcagatgttcggagatcttcttcgcccattcgtaggcttcagcatgcagctgagactcgtacgggttagaggtacacagcacgttacggttcatgtcgttggcggttgccagcgcatccagccccaccgagtgcagcatctggtgcaccggcttaacgttcttcttcagaatgccgtggaactggaaggtctggcggttggtcagacggatactgccgtaaatcgtgttatccgccgcgaatttatcgatcgcctgccattgcgtcgtagtaatcaccccgcccggcaggcggcagcgcagcagcatcgcgtggcgcggctccagcttctgcgccgcacgctcggcgcgaatatcgcggtcatcctgctgatacatgccatgaaagcgtatcagcaggaagttatcgcctttaaaaccgccggtgagaccgtcgttcagatcttccgcaatggtgccgcgcagatagttgctttccagcttcatgcgctcggcatcggacagtttaccttcgaccaccagtgggcctggatgtttttcgctcattagtagacatctcgctgataacggcgctctacgcgcagctcacttaaatattcatctgccgattcgaggtccataccgccgaattcagcgatcacttccagcaatgctttttcgacatctgcggccatgcgcctggcgtcgccgcagacataaatatgcgcgccatcattgatccagcgccacagctcggcgccctgttcacgcagcttgtcttgtacgtaaattttttctttttgatcgcgtgaccaggcgagatcgatacggcttaacaccccctctttcacgtagcgctgccactccacctgatagaggaaatcttcggtaaagtgcgggttgccgaagaacaaccagttcttaccttccaccccttccgccgcgcgctgttgcataaaggagcggaacggcgcgatgccggtaccggggccaatcatgatcaccggcgtttccgggttagctggcaggcggaagttatcgttatgctcaataaagacgcgaacttcgccctcttcttccacgcggtcggcgaggaagctggaagcgccaccggcgcgggcgcggccttcaatgtcataacgaaccacgccaacggtgatatgcacttcgctctccacttcagcctgtgcggaggcgatggagtacagacgcggcgttagcggacgcagcaggtcgattagcgcctgagcatccagctgtgccggagagaaacgcaccatatcaacaatgggcgtggtcgcggcgtaatgctggagctgcgctttgtcgcccactaatggcaacagcgactcactgcgcgtcagggtcgcgtagttctcaacaatgttggcggtattcaccgtcagctcgaagtgccactccagcgcttcggcgagcggcagggttttaccgtcaaccgtcaccggctcatcgcccttcagccacagcaactcaaccagctccttcaccagagccggatcgttctgataccagacgcccagcgcatcgcccggctgatagcgcaggccggagtcgcctaaatcaatctcaatatgacgcacatctttttccgagttgcgaccggtgattttctgattcacggagagggtcgcgatcagcggcgcgtctttagtataggggctggtgtggatgtcgtttaccgcgccagtagcgacggattgcgaaggtgccgcgacaggtgcgcgagacttcagaacatcaaccacgcgggcgcgccattcgctggcagctgcctgatattcaacgtcagcatcgacacggtcgagcagacgttcaccgcccagttccgccagtttgctgtcgaaatcttttccggactggcagaaaaattcataagaggtgtcgccgaggctaaacacggcaaaagcggtgttttccagtttcggcgcttttttggagaacaggaatttatgcagcgcgacggcctcttccggcggctcgccttctccctgggtggacgtcactatcaccaacagtttttcactggcaatctgtttgaatttgtagtcgccggcgttcaccagtgtcacattaaggttggccgccagcagatcatcacgcagcgcttccgccacacgacgcgcattgccggtttgcgaagcggagataagcgtaacccgcggcatcttccgctcaggaacaggcgtgacggcaacagcgcctgagcgcgggttcagtacgccccaaaaatagccggagacccaggcaagctgttcgggagtaaggtcggttgtcgcggcctgaaggcgcgccagttgctccggattaagcggaagcaacccagtcagtggagccggtgtcgtcatgcgtcgttatgttccagtaagcaaagcggatctatacacaaaatcattcaagttcgccgtaagctgatcgcgccccaggagcgtacataaatacgtgactggggtgagtaaacgcagtcaacacagatgcggcttgaaagatgaaatgtataagcgataaatcccaaactgaggataaggttaacggtgagaggaataacaattaaagaagggttggaaataacaaataaccaaatgaactaacctgttttagttatcgttattaacgccaaaatcgattttataattgattgataattattaaattttctggaaattcttaaattaattgcccgtcacaaggcggagaatggttttagttaatgataaaaaatgcgctttccggtaccctacggcggtttttttattgcctgagagttcatcatgtccaccacgttgtataaagatttcacctttgaagccgctcaccgcctgcctcacgtgcctgaagggcataagtgcggccgcctgcacggacactcgtttatggtgcgtctcgaaattaccggtgaagtcgatccgcataccggttggattatggatttcgcggatctcaaagcggcgtttaaaccgacttacgatcgtcttgatcactactatctgaatgatattccagggctgtccaatcccaccagcgaagtgctggcaaaatggatttgggatcaggttaagcccgtcgtgccgctactgagcgccgtgatggtgaaagagacctgtacagccggctgcgtctatcgcggcgaataaggtttattaacgcgtgggctggatgtcaaattgattccagcctatccacacgacgtttcatcagtgaaaacagtccagcgcgtggtgttaaaagcgcagtacatcaccggttgcaggtgcggttatttccggtagccacaaccgcccccaggcccctgtacagtgacaaccgcatagtttttcaggtttatgttcttgcagaaagcgcctgactcgccacagcgtgaacggtgatgcgcagcggagatgaaatccgccgacaagcgcgtaactccgctttataccagtaatattctgacagtgccggacaatatttgcgatcccccgatgcccgcatcccgtaatgatgactaatccttttgtcgattggtaaatcagtacgccctcatccaaaatagagtccggctccgcatcgtggccgccaaaaatgccgtaggcttcaggcgcgaccaccggtatttcccctgaccagataaagttttcgccaatcggcagggggtcacgcgtgtacatcattcgatagcgtgaatagtccacctcacacgacaatttttttatttttcgggtaataccaagaaaagtcattgctgcataacgttcacgtgcaatatcgggatggcagatgattcgactgctatcaggaagccacggcacgccgccgcaatgatcgtaatgaccatgcgaaagcaccacagcagacacatcggacaggtcgatccccatcgccaacgcgttttgcataaaactgccatcagggccggtatcgaacaagatagacgtagactcatcctcgaccaacaggcttaaccctggccggaccttcaacgatttatccgctccagctcccttatgattttcgagcaataccctgatccttaacgccatggccttctcctgtctaaaagcctccccgggaaaacgcggcctttttactttacaggtttgtagctgccattactggtacacagattatgattatgcaacggctatccttgttggcgcggggaacacatcttcatattgcgtgacgctgccgatgaacgcggtttatccccgctggcgcggggaacactctttatcagctaaccatttccagaactcgtccggtttatccctgctggcgcggggaacactataatatgaattaatttttgcgcataacctgcggtttatccccgctggcgcggggaacactgcccgttctgcctcttcgcactctcgatcaacggtttatccccgctggcgcggggaacactgcgtaatgggctacctgaacttcacatatcccggtttatccccgctagcgcggggaacatattaagcgcgcaaagtttgggttaattggacacggtttatccccgctggcgcggggaacaccgtattcgtcacacagccccgtccagaaatgacggtttatccccgctggcacggggaacactaacgaactgaataaaatgtcagaaagtgacgcggcttatccccgctggcgcggggaacacgcagcttagcgacgaaattaaaaccgaactcaccggtttatccccgctggcgcggggaacactgccagtgactacagaagcgtcgctatcggggcggtttatccccgctggcgcggggaacacaccgataaacaaccgcatagcctctttcgtttcgatttatccctgctggcgcggggaacactgctcaataacgtcgtaaatagcgtaagctggcggtttatccccgctggcgcggggaacactatttcgccttcggcactgacgtcaccgtcaacggtttatccccgctggcgcggggaacacgtcgcgttcgttgccggtatagaccagcgtcacggtttatccccgctggcgcggggaacacatcgaatcgaaaccccagccacagaaataattcggtttatccccgctggcgcggggaacacgctcatgtcaaacgccatcagcgttccggcatcggtttatccccgctagcgcggggaacacaatcgccagcctcggaaatattccatcctccgcggtttatccccgctggcgcggggaacacaggaactaaacagcctgaccgttgaggatctgcggtttatccccgctggcgcggggaacacaccggacaaatcttttttttcctgttcctgttcggtttatccccgctggcgcggggaacacgggcactatgaacggatcggcgctgatgccggcggtttatccccgctggcgcggggaacacggtaaagccacaccattttttattgacctcgccggtttatccccgctggcgcggggaacacgtggtggcctcaaataaattcgagcgctggagcggtttatccccgctggcgcggggaacactcgacgtggacgaggagttactcaaccgctgcggtttatccccgctggcgcggggaacacagcgccacatggcccaccggcaccacccgatccggtttatccccgctggcgcggggaacacaaatgaccaaatcagaaatcttcaccaaagcccggtttatccccgctggcgcggggaacactaatggccacagtaagtcaaacggttctggaacggtttatccccgctggcgcggggaacacgagtccgggggttatatagttatttaatgagccggtttatccccgctggcgcggggaacacttgggcgtcggttttttcaggtttaggtccggcggtttatccccgctggcgcggggaacactcaactgtcagttcgtcgttagccagtaattccggtttatccccgctggcgcggggaacacctgaaaacgcatggaatccggtataaacagtccggtttatccccgctggcgcggggaacacgatgtaactgatagcgaaatatattgggataacggtttatccccgctggcgcggggaacacgaaacgtaaacagggtaagatacaactctgcacggtttatccccgctggcgcggggaacacactaaacggatataattgtttataaactactttttgtcagcaccacattctaccaacataatcgcaacaatttaaattattaaagaacagctaatttgctgattttgatgcaaaaaagttcatagaatgattttttctttaaatttaccaaaatagcgtgatccgtgcatcgctatggaaaaatttatcagcgcttttatacactcatcgaaattcacatagagaaaataaacaatgcaaggtaatggatgagtcacagacggcatcggcaggccgtctgtaagattagtaatgcatcaggcgatatttaaatatttatgcgtttgcatagacagcctccagttacgtgcaatacacgtttcaatacacagacgcgtcgcgtcttctttctggctaatgggctgcaaagcaatcacacgcggtttatcatcgctcaacgtggctaacagttcatccagcgcctcaatatcacgaactcgcccaacgggatgcttgatttcattggcgcgctccagcgcctgggaaagcacgtcatatcccccgcgcatattcacttttggtgaaaccgtgacccaggtgttaggcgtacagcgcacttcgtgcgtcccgctggtttcaatctgacaactaaaaccactcttttcaagcagatcggtgagcggcatgaggtcgtgaatacagggttcgccaccggtgatgacaacgtgacgcgcggtatagccctgacgattaattactgccagcaagtcttcactgctcgcagcaccccatttgtcgctctctttggtttttgccagaatgctgaacagagacacttcccgatcgctcagtttatcccaggtatgcttagtatcacaccaggcacagccgaccggacatccctgtaaacgaataaaaatagcggggacgccggtaaaataaccctcgccttgtagggtctggaacatctcgttaatcgggtactgcatagcgttctctattaaggggataatcgttaattattgcagatttcgtctgcccggtcatgcacagcggctgcgctattgaacagatacaaaaaaacccgccgaagcgggtttatacgttaagaggtaaaagcaggattacgcctggcctttgatctctttacgaccgttatacggtgctttttcgcccagagcttcttcgatacgaatcagctggttgtatttagcaacacggtcagaacggctcatagaaccggttttgatctggcctgcagcggtaccaacagccaggtcagcgatggtagcgtcttcagtttcgccagaacggtgagagatgacagcagtatagccagcgtctttcgccatcttgattgcagccagagtttcggtcagagaaccgatctggttgaatttgatcaggatggagttagcgatgcctttctcgatgccttctttcaggattttggtgttggttacgaacaggtcgtcaccaaccagctggattttgtcgcccagtactttggtctggtatgcaaaaccgtcccagtcagactcgtccagaccatcttcgatggaaacgatcgggtactgtttggtcagttcttccaggaagtgggtgaattcttcggaggtgaacgctttgttgccttcgccagccagaacgtatttaccgtctttgtagaattcagatgctgcgcagtccatcgccagggtgatgtctttacccagctcgtaaccagccgctttaaccgcttcagcgataacagccagcgcttcagcgttggaacccaggttcggcgcatagccgccttcgtcacccacagcggtgttcatgcctttgcctttcagcacttttgccaggtgatggaaaacttcagaacccatacggatggcttctttaaccgttttcgcgccaaccggctggatcatgaattcctggatgtcgacgttgttgtcagcgtgctcgccgccgttgatgatgttcatcatcggaaccggcatggagtatttgcccggcgtgccattcagttcagcaatgtgctcgtacagcggcatacctttagcggcagcagcagctttggcgttagccagagagacagccagaatggcgtttgcaccgaagttagatttgttttcagtaccgtccaggtcgatcatgattttgtcgatgccagcctggtctttagcgtctttgccaagaatagcctgagcgatcgggccgttaaccgcgccaacagctttggttacgcctttacccaggaaacgggatttgtcgccatcgcgcagttccagcgcttcgcgggaaccagtagaagcacctgacggagccgccgccatacctacgaaaccaccttccaggtgtacttcagcttcaacagtcgggttaccacgggagtcgatgatttcacgaccgatgactttaacgattttggacattaggttttcctcaagtcactagttaaactaaaacttcagacaaacggtgcaccgctgagggtgcaccgccgttctaacttttttacttcgcctgacgtttctgatgctcgttggcggctttaacaaagccagcgaacaacggatgtccatcacgcggcgtggaagtaaattccggatggaactgacaggccacgaaccacggatgattcggtacctcaatgatctcgactaactgatcatcaccggaacggcctgcgacacgcagacccgctgcttcaatttgtttcaacaacatattgttgacttcgtaacgatggcgatgacgttcaacaatcgtcgacgcgccgtacaactgacgtaccagactgtcatcgctaagctggcactgctgcgcgcccaggcgcatggtgccgcccagatcgcttttctcgctacggacttcaacgttaccgtcttcatcgcgccactcggtaattaacgccacaaccgggtacttacagtctggcacaaattccgttgagttggcgttgtccatgccggccacgttacgagcgaactcaatcaacgcaacctgcatccccaagcaaatgcccagataaggaatattgttttcacgcgcatagcgcgcagtggcgattttaccttcaacgccacgatagccgaagccgccggggatcaggatagcgtccaaatctttcagaatttcgacgccgcgcgtttcaacatcttgcgaatcgatcaatttgatgttgacggtaacgcggtttttcagaccaccgtgtttcagcgcttcgatcaccgacttataggcatccggcagttcaatatatttgccgaccatgccgatagtcacttcgcctgccgggttcgcttcttcgtaaatgacctgttcccattcagacaggttagcttccggacagttcaagctgaatcgtttacaaatataatcatcaagcccctgagatttcaacaggcccggaattttataaatggaatcgacatctttcattgaaataacggctttttccggcacattacagaacaatgcaatttttgcacgctcgttggcaggaaccgcgcgatcggaacgacaaatcagaatatcgggctgaataccgatagacagcagctctttcacggagtgctgagtcggtttagttttcacttcgcccgcagccgccaggtaaggtaccagcgtcaggtgcataaacagcgcgtgttcacgaccgatatctaccgccaattgacgaatcgcctcaagaaacggcagcgattcgatatcaccgacggtaccgccgatttccaccagtaccacatcgtggccttcgccaccttccagcacgcgctctttaatcgcgttagtgatgtgagggatgacctgtacggttgcgcccagatagtcgccacggcgttctttacgcagaacgtcggagtagatgcggccagtcgtgaagttgttgcggcgagacatcttggtgcggatgaaacgctcgtagtgccccaggtccaggtcggtttcagcgccgtcttcagtaacgaacacttccccgtgttggattgggctcatagtacccggatcgacgttgatgtacggatccagtttcatgatggtcacgttgagaccacgggcttccagaatggctgcgagggaggctgcggcaatgcctttacccagagaggatacgaccccgccggtcacaaaaatatagttcgttgtcatgcggaacctgagaagttaggtttaaaagacgatggaataaccaggacgggaaagcagtatacccgaacatgacctacgccacaaactttcattattcctcctcttcgtcaggctgacattcacacagggagggagaaaatagcccctttgaggtaaatgtttttgacgtaaatcaagcgcttgttatttaaaaaatcacacaaatcgctcttgaccgcctaaaacctttagagatcaatttcctggcgttttacttcctgccaaacttcttccattgtttccaggtccaccccggtcatttccaggcctctggctgcgacaatacgttcaacttcgcgaaaacgacgttcaaatttatcgttcgctttttgcaaagcgagctccgctttcgtacctaaatgacgcgccatgttgaccgtggcaaagagcaaatcgcccatttcctcttccagtttagcctgatcaacaaccgcctgccgcgcctcgaacatcacctcatcgatctcttcatagaccttatcgacgaccggtcccagcgtcgtccagtcaaagcccacgtttgaacaccgtttctggattttttgcgcgcgcattaaggccgggaagctgcgcggaatatcgtccagcgcggaatgctgcgctttttgcgcgcgctcttccgttttgatttgctcccagcgaactaatgcttcttcgctattatccgcggaaagctcgccaaaaacatgcggatggcggcgctccagcttgtcgctgatggcagcgcagatatcattaaaatcgaagcggccttcttcctgcgccatctgcgcgtaaaacaccacctggaacaacaggtcgcccagttcgccgcgcaaatcgtcaaaatcctcacgcgcaatcgcatccagtacttcataggtttcttccagcgtataaggcgcgatgctggcgaaggtctgctctttatcccacgggcagccgttttccgggtcgcgcaggcgctgcatgagggtgagaagacggtcaatttgatggttagttgtcatggtttttaatcggttgtaaataccagcgacaattgtaacgtattattcttaaccattcacgcacagagacactacgacaacgcctatataataaaatatattgttaacaggtgttgaatgctacctttcccgtataactttaaaattattaatcgatacacaacaatataataatcatataactaatttattaaaaaaacagatatttgcaccagacgttataaataacatcaattaagtaaaaaaatcatgcaaacactataagcaccccacccaaagagccttccctttcaaaaaaaaataaattatttcacttttacggaaaaacgagtagcatgcacgccagtttaatattcaaaaaagaccgcttttttgttttttctggaacatacatgaaataaatatattgaaagtattacatataatattctatgagcaggtacgatcattcagctcataagaatatactcatagaaatgtagaaatataatatttttattatgacctatttttacccaaagcccgcagcatggctctatgccgcatatcccttggtatacgcgtacaaaatgttgccataaaacacgttaattaaggataacacgatgaagtcatctcatttttgtaaactggcagtaactgcatctttagttatgggaattgtctccggcgctcaagccgcgggtagcaacacagcaaaggtcactttccttggtaatattgttgattccccctgctctctcacacttgttttttagataaaaaggctataaccaatttacatgcttaccagcatcctgattctggctcagaatacgtatcacgataacttccgtaactgattgtataaaatagataatatgccttttaaacggtaaggcataaatgtattcacccagttcaggtcgaggcgtgccaatgttattggcactcataatgctgaatatttctgatagatgattaatatatcgatcggcctgtatttcgccaaaatgctgccagccgtaatgccagatattttccagatcttcactggcctttggcgttaattttaccattctcatcgggtttgatcatccctgttttgaccttccgtaaaaaggcatccttttcccaggcctgcggctctccgctgttcagaccttcagccagaagttcacgtaacgcctgaagtcgtgactcggcctgtttttccctcagcagacgaagagactctctgatcacttcactttgtgttctgtaatcacctgattctatgagcgattcaataaactcgcgcagttcatcgccaagatcaacggtcattgttctggccataacagcctccactgtaagtataaatcttacataagagtacaccggaaatgaaatgtacgtcaaaaacataccccatatctcatgcttatggggttgctaatgcggctttgctgaacgagtagcaaagccgctacatgattactgtctggggtttaccccccgtgcagtcgccgtgcatcaatcacatccggcacctggttcagcttaccgagcacccggcccagcacctgcaggttgtagatctcgatggtcatatcaatggtggcgatctgctgtttaatgtcgctgcggctggcgacgcccagcacgttgactttttcgttagccagaatggtggtgatatcgcgtagcaagccgctgcgatcgttggcctggacgcgcaccaccagcgaatatcccgccgagtagctctcgccccataccgcctctacgatccgctccggcgcatgggagcgcagttccgccagctgttcgcagtcggcccggtgcacggaaatccctcgcccttgagtaatgaagccgacaatttcatcccccggaatcggctggcagcagcgggcgatgtggtgcatcaaattacccacgccttctaccaccacgcgcccgtcgtctttacgacgattttgcggcgcgtatgttttttgctgaagctgtttcagcgccgctgcatcctgctcctctgcactcggcttattgaactgtgattgcaggaaattcaccatctgattaagacggatatcgccgccgcctatcgccgccagcaactcttccagctcattaaagttgtagcgcggcagcagatgtttttcggcctctttcaggctaatccccaaatgcgccagctcatcgtcgaggatctgccgtccagcctggatatttttgtcacgatcctgcttgcggaaccaggcgtgaattttcgagcgtccgcggctggtcgtcacatagcccaggtttggattcagccagtcgcggctgggattcggctgcttctgagtgataatttcaatttgatcacccatctgcaactgataggtgaatggcacaatacggccgccgattttagcgccaatgcagcggtgcccaacatcgctgtggatgtggtaagcaaaatcgagcggcgtagatccggcaggcaagtcaaccacgtcgccttttggcgtaaaaacgtagacccgatcgtcaaacacctggctgcgcacttcatccagcatttcgccggaatcggccatctcttcctgccaggcgatcagcttacgcagccacgcaattctgtcttcatgaccggagcgcacgccgccggacgcggcgccttctttatacttccagtgtgccgccacgcccagttcggcgtcttcatgcatctgtttggtacggatctggatctcaacggttttaccgcccggtcccaggaccacggtgtggatagactggtaaccgttcggtttcgggttagcgacataatcatcgaattcatccggcaggtgacgatagtgcgtatgcactatccccaacgcggcgtagcagtcctgcagacgttcagcgacaatacgcacggcgcgcacgtcaaagagttcatcaaacgccagatgctttttctgcattttgcgccagatgctataaatatgttttggtcgtccgtagacctccgcctgcacgccttcgtttttcatttcggcgcgcagatgtccaacaaactcttcgatgtaatgttcgcgatcgagacggcgctcatgcagcagtttggcgatgcgtttgtattccgccggatgcaggtagcggaaacagtagtcttccagttcccacttcagttgcccgatgcccagacgattggcgagcggcgcatagatgttggtacattctttcgccgccagcacgcgctcatcttccggcgcctctttcacttcgcgcaaatgagcgattcgctcggccagtttgatcaccacgcagcggaaatcatccaccatcgccaataacattcgacggacgttatcaacctgctccgaagaaacagagtcgttatgagtggcgtttagctgacggatcgccgccatatcgcgcacgccatgaatcagggtaacgatagatttgccgacgctttcgcgcagtacatcttcgctgactacgttggcgtcggccagagggaacagtagcgccgcccgcagcgtgtcgatatccatactcagcgtggaaagaatttctaccatctccacgccacgccacagcaacagatccgcatccggatgtccttgtgtctgttgcaggcaatacgcccaggtttcggctaagcgctcacacgactgctggctggaaattcccaggcttgcgatccacttcttcggatcaaattcaccagctttattaatatgtgcacttcttaccgcgaccatcgtcctctccttaagggaccaggcctaccgaagtcggtaagccggtaatcattacatgcgctcgaacagaaccattgattccagatgtcctgtgtgcgggaacatgtcgagcatcgctaaacgcgtaacctcatatcccgcattgaccagcgcttcactatcgcgcgccagcgtcgccgggttacaggatacataaacaatgcgaataggttttaattttataatatgtcgcatcactcctgtagcccccgcacgcgcaggatcgagtaagactttgtcaaagccgtttttcgcccacggctgcttcgtgacatcttcctccaggttctcatggaagaatgtcacattatgtaaaccattgcggatggcgttttcacggcctttttctaccagcgccggaacgccctcaaccccaatcacgcttgccgcgcgcgttgccagcggcagcgtaaaattccccattccgcagaacagatccaggacacgatcctcggcgcgcacatcaagccactccagcgcgcgggcgaccatttgctggtttaccgcctcattaacctgaataaagtctcgcggactgaaggctaaacgtaagccgtgcgaatcataccagggcgcctcgccagataccgtttccagtatctcgctaaacggcgccagaaacagagacaatccctcagaatgcgaaaagcgttccagtttttctttatccgccgcacttaatggcgcggtatggcgcagaatcatcagcgtaccgcttcccgcctgtaccagctcaacatgcccaagatgtcgggtgccgtgtaaactcgccagacacgccctgattcggggcagcaatgctgcaagctggggcgccaaaacggggcactgttcgacattgacgatatcgctggaacccgctttgcgaaatcccatttgcagcggtttatccggcgggcaattcagacttaaccgcgcacgacgccgataaccccaaggcgcgccggcgatgatgtcattcacctcgtgtttcatcaaacgcgccagcgccgcgcttttgctgcgttgttgcagggcgatgctgacatgctgttgctgacaaccgccgcagacgccaaaatgcgggcagcgcggcgtttctcgttccgggctatcattcaaacggcgcgaaacgcgtgcgcgggcaaattgctttttatcttctgtaataatgacttctgcgctttcctcaggcaataaaccggggataaacagcgcttttccgttatgacgggctacgccctgaccaaatgaatcgaggtcattgactttaacggttatgatctgacgcgtcgtcacgcgccgttttgcagagtagaattgcgccatcgaccagctttttctcaatttaacagtgtgaccctaattgtcccataacggaactccatgaccaactacagcctgcgcgcacgcatgatgattctgatcctggccccgaccgtcctgataggtttgctgctcagtatcttttttgtagtgcaccgctataacgacctgcagcgtcaactggaagatgccggcgccagtattattgaaccgctcgccgtctccagcgaatatggtatgaacttacaaaaccgggagtctatcggccaacttatcagcgtcctgcaccgcagacactctgatattgtgcgggcgatttccgtttatgacgatcataaccgtctgtttgtaacgtctaatttccatctggacccctcacagatgcagcttcccgccggagcgccgtttccacgtcgtctgagcgttgatcgccacggcgatattatgattctgcgcaccccaattatctcggagagctattcgccggacgagtcagcgattgctgacgcgaaaaataccaaaaatatgctggggtatgtggcgcttgaactggatctcaagtcggtcaggctacagcaatacaaagagatttttatctccagcgtgatgatgcttttttgtattggcattgcgctgatctttggctggcggcttatgcgcgatgtcaccgggcctatccgtaatatggtgaataccgttgaccgcattcgccgcggacaactggatagccgggtggaaggatttatgctgggcgaactggatatgctgaaaaacggcattaattccatggcgatgtcgcttgccgcctatcacgaagagatgcagcataatatcgatcaggccacttcggacctgcgtgaaacccttgagcagatggaaatccaaaacgttgagctggatctggcgaaaaagcgtgcccaggaagcggcgcgtattaagtcggagttcctggcgaacatgtcgcacgaactgcgaacgccgctgaacggcgtcattggctttacccgcctgacattaaaaacggagctgaatcccacccagcgcgaccatctgaacaccattgagcgttccgcgaataatctgctggcgatcattaatgacgtgcttgatttctccaagctggaagccggtaagctcattctggaaagtatcccttttccactgcgtaatacgctggatgaagtggttacgctgctggctcactcgtcgcatgataaagggctggagttgacgttaaatattaaaaacgacgtcccggataatgtgattggcgacccgctgcgcctgcaacaggtcattactaatctggtgggtaatgccattaagttcaccgagagtggcaatatcgacattctggtagaaaagcgggcgctcagtaacaccaaagtacagattgaagtgcagatccgcgatacggggatcggcattccggaacgcgaccagtcgcgactgtttcaggcgtttcgccaggccgatgccagtatttctcgccgtcacggcggcaccgggcttgggctggtgattacgcaaaagctggtcaacgaaatgggcggggatatctctttccacagccagcctaatcgcggctcgaccttctggtttcatattaatcttgatcttaacccaaatgtcattattgacgggccgtcgaccgcgtgtctggccgggaaacggctggcttatgtcgaaccgaatgctaccgccgcgcaatgtaccctggatctactgagcgacacgccggtggaggtggtttacagcccgaccttctccgcgctgccgttagcgcactacgatattatgattttgagcgttccggtgaccttccgcgagccgctcaccatgcagcatgaacgtctggcgaaagcagcgtcaatgacggactttctactgctggcgctaccttgccatgcgcaaattaacgccgaaaagctgaaacaaggaggcgcggcggcctgtctgttaaaaccattgacgtcaacgcgcctgttgccagcgctgacggaatattgccagttgaatcaccatcctgaaccgctgctaatggataccagtaaaatcaccatgacggttatggcggttgatgataatcccgctaatctgaagcttatcggcgcgttactggaagataaagtccagcacgtagagctttgtgatagcggacatcaggcggtggatcgggcgaaacaaatgcagtttgatctgattttgatggatattcagatgccggatatggacggcatacgcgcctgcgaattgattcaccagcttcctcatcagcagcaaacaccggttattgccgttacggcacatgcgatggccgggcaaaaagagaagttgctcagcgcgggcatgaacgactatctggctaaaccgatagaagaagagaagttgcataatctgttgctgcgctataaacctggcgccaacgtagcagcgcgcctgatggcgccggaaccagctgaatttatcttcaatccgaatgcaacgctcgactggcagcttgcgctccgccaggctgccggtaagcccgatctggcgcgggatatgctgcaaatgctgattgattttctgccggaagtgcgcaacaaaattgaagaacaactggtgggagaaaatcccaacggcctggtcgatctggtccataagctacacgggagctgcggctatagcggcgtaccgcggatgaagaacctttgccagcttattgagcaacagcttcgcagcggcgtccacgaagaggagctggagcctgagtttctggagctgctggatgagatggataatgtcgcgcgtgaagcgaagaagatattaggctgatattcgccggatggcggcgtgaccgccttatccggcctacaactcagcgtaactgttgccccgctttcagcgttgcagccacgttgcgcgcggtcattcgtacgttttcactcgcattcttcagcgcgtcctccagcgtgcagatggtataaatcacgctgaaaaccgcatcaagcccatgttcatgaaccacgctaacgtccgccgtcaggctacccgcaataccaattaccggcttgttataccgtttggcgatgtttgccacgccaatagggactttaccgtgaatggtctggctgtcgatgcgtccctcgccggtgatgactaaatcagcatccgcaagacacgcttccagatgaagcgcatcggtgacaatctcaatgccacgccgtagctgcgcgccgcaaaacgcgtataacgccgcccccatgccgcctgccgcgccgccgcctgccagatccaacacatcgacatgcagatcgcgggcaatcaaatgcgcatagcgagtcaatgccgtatccaggcgttcaatcatttccggcgtcgcccctttttgcggaccaaaaaccgcagacgcgccctctttgccggtaaggggattcgtgacatcgcaggcgacctctatatggcacgccgacaaacgcttatccaggccgctgatatcaatgctggcgagtgtttccagcccaatgccgccttgcgcaatatcattgccctgcgcatcccgtagcctggcccccagcgcctgtaccatccccgcgccgccatcgttggtggcgctaccgccgataccaataatgatatgctcaacgcccgcatccagcgcatgacggatcagctcgccggttccccatgacgtggtcttcaacggatcgcgttgcgcgggcggcacctgctccagcccgctggcggccgccatttcaatgaacgcggaacgcgcatcgccggaaagcccataaaacgcattgacgcgatgccccaacggcccggtgacctcaacatgcacgattcgacccgccgtcgcttcaaccatcgcttcgacagtaccttctccgccatcagccagcggcaatttcaggtaatcggcgtcaggccagatctcgcgaaatccttgttcaatggcggtcgctacctcaagagcactcaaactttccttatacgagtctggtgcgatcactattttcataagtcgtccttacgcatgttgatcctgttaagcatacacccagagaagaaccggttccttacggaaccggctctgacttaacgcaccatgcaaggacgcttattatcaaacgtccagccaggaattaagtactgcattcccatcgcgtcgtcacgcgcgcctaagccatgtttttgatagagctcatgcgctttcatcacctgatccatatcgagctcaacgcccagacccggtttggtcggtacttgcaccatgccgcctttaatttcaaacggttctttagtcagacgttggttgccttcctgccagatccagtgggtatcgatcgcggtgatcttgcccggcgccgccgcggcaacatgggtaaacatcgccaacgaaatatcaaagtggttgttagagtgcgagccccaggtcagaccgaactcatggcacatttgcgccacgcgtacagagccttgcatagtccagaagtgcgggtccgccagcgggatatcgacggattgcagcgacagcgtatgccccatttgacgccagtcggtcgctatcatattggtggccgtcggtaatccggtcgcgcgacggaattccgccatcacttcacgaccagaaaaaccctgctccgcgccgcacggatcttctgcataggccagagaacctttcaggtatttaccaatgctgatcgcttcgttcagcgaccaggcaccgtttggatcgagcgtaacgcgcgcttgtgggaaacgtttcgccagcgccacgattgactcggcctcttcttcgcccgccagcacgccgcctttcagtttgaagtcgttgaagccgtatttttcataggcagcttccgccagacgcactaccgtttccggcgtcatcgcctcttcatggcgcagacgataccagtcgcattgctcatccggctggctctgatacggcagcggcgtggccttgcgattgccgacaaagaacagataacccagcatttcgacttcgctgcgctgctgaccgtcgcctaacagcgaagcgacgttgacgcccaggtgttggcccaaaaggtcaagcattgccgcttcaatgccagtcaccacatggatagtggtacggagatcgaacgtttgtaagccgcgtccgcccgcatcgcgatcggcaaactggttgcgaacggcggtcaggacatttttatattcacccagcgtttttcccaccaccagtgggatcgcatcttccagcgttttgcgaattttttcgccgcccggaatctcgccaaccccggtatggccggagttatctttaataatgacgatgttgcgcgtgaagaacggggcgtgcgcgccgctcaggttcatcagcatactgtcatgacccgcaaccgggataacctgcatttcagtcactacaggcgtcgtaaattgagtactcataactgtgtccttattcagaattagtgacgaccaaaaacagggcgtttgcggtcaaaagtccagccggggatcaggtattgcatcgggcctgcatcattacgcgcgccgcctggcagctttttatacgcgtcatgcgcttttcgcacctgttcccagtcaagctccacgcccagtcctggcgcatccggaacggcaattttgccgtttttaatttccagcggatttttagtcaggcggcaatcgccctcctgccagatccagtgcgtatcaatagcggtgggtttgcctggcgccgccgcgccgacatgggtaaacatcgccagtgaaatatcaaaatggttattcgaatggcagccccaggttagcccccagtcatcacacagttgcgccacgcgaacggcgccggtgagggtccagaaatgcggatcggcaagaggaatgtctaccgcgttgagcatcaccgcgtgtcccatttcacgccagttggtggcaatcatattggtcgctaccggcagtcctgtcgcgcggcggaactccgccatgacttcacgaccagagaatccttgctccgcgccgcacggatcttccgcgtaggtcagtacatcattcagccctttgcacaacgcaatggcttcatccagtagccaggcgccgttcggatccacggtaatacgcgcgtccgggaagcgtttttttagcgcgcgaacagtatcaatctcttgttcgcccggcagcacgccgcccttgagtttaaaatctttaaagccgtagcgatcctgagacgcttccgccagccgcacgaccgcgtcgctgtccagcgcttcctgatgacgcaggcgataccattcatgactgcccggcgtgctttccagatacggcagatcggttttagtgcgatcgccaatatagaagagatagcccaacacggtgacggcatcgcgctgtttaccgggtcctaacagttcacagaccggcacattaagcgcctgccccagtagatcaagcagcgccgcttccaaagctgccaccgcgttaacccgcagttcaaacgtccatgcgcctttaccaaaggtgtcaaaatcagcagcctggttgcctttatgcacctgctgcaccactttgttcaggcgggcgacttcctggcctaataccatcggaatagcatcgaccagcgtctgataaatcacttctccgcccggcgcctcgccgacgccagtatgcccggcgttatcggtgaggatgacgatgttacgggtgaagtacgcgttatgcgcgccgccgatgttgagtagcatactgtcatgtccggcaaccggaatgaccttcatgtccgtaataacgggactggattgcgttgtcatgataattgtcctgcgacaggtttcagttcaatacgcttaatatcgcctaccagcaccagatagctgatgatggccaccagggcatgtacgccgacatagatcaacgcgccgttgaaggaaccggtggtgccaacgatgtaaccaatcgcgattggcgtcacaataccggaaatattgccgaacatattaaacaagccgccggaaagaccgctgatctctttcggcgcggtatccgccattactgcccagcccaacgcgccgatacctttaccgaagaaggccaacgccataaagccgatgatcatccattccacgttcacatagttacagaacaccatgaccattgacagcaacatccccagcacaatcggcgtcttgcgcgcgatattcagggagccggtacgacgcatcagccagtcggaaatgatgccgcccaacacgccgccgataaagccgcagaccgcaggaaccgaggcgacaaagcccgctttgagaatcgacatgccgcgcgcctggaccaaatagaccgggaaccaggtaataaagaaataggtcaatgcgttaatacagtactgaccgatgtaaacgccaatcatcatacgagagcccagcagctgtttgatctggccccatttgacgctaaacggtactttcgctttggtgtctttctgatccatattgatcagcgcgccgccttctgcgatgtactccaactctttcttatttacgcccggatggttatttggttcatggataactttcaaccagataaagctgatgatgatccctaacccgcccataaagaagaagacatgcgaccagcccacttcgtgcgtcagccagcccataatcggcgcgaaaataaccgtggcaaagtattgcgcggagttaaagatggccaccgccgttcccctctcctgcgccgggaaccaggctgcaacaatgcgactgttgcccgggaaagaaggcgattccgccagaccaaccaggaaacgaagcgtaaagagggcgacaataatgccgaaaccactaaagatatcgacaaaaccctgcaacagggtgaagactgaccaaatgaaaatagaccagaaatagacgcgtttggaaccaaagcggtccagcagccagccgcccgggatctgcccgataacataggcccatgaaaaagcagaaaaaacatagcccatgcctaccggatcaaggccgatatctttggccatttctgagccggcaatggacaatgtggcgcggtcgccgtagttgaaggatgtgacgataaacagcatcaccactatccagtagcgggcgttcgtgcgtttctccgcactgctcgccgcgtgacttaatgaactcattgttgcactcctgaaatttcgcgttagctacgctcactctgaactgcacaaccggtagggaatcagagataacgtttccttgttgcagcttttattaggtcgtttgctttgcacgctgcatgcttttattcactggcaggagaagtataaaaagcgcgccacacacactcaccgtgcaacaacacagtattttggcgatgaattacgcctgtttatggcaaaagcccaggacagtggaagccacttcacggaaatgaaatcagaaggcgtcggcgtcgacgcaggaggagtaaaaagagaagaatgtgaaacaggtcgcttgattacatgaaaacgcccgtaaaaaactgctgcttttgcgggcatatgcacaaagctaacacgattcagttactttacactgtgtacaggtcatgattttgcttactggcaacgcaagcaaacgaaaaggtaccctcccgtaggggggagggatttacctcaggaaagtaaagttccccagttttcaacccagggattggactggctctccggctccggatgttcgctggcgtcaatgaataacatctcccccacccgctgcgcgctttgctcttgcaacagggcatcaaactgtttgccgccattacagaaattggggtagctgctatcacctaacgcaatcaccccgtaacgcaggtttggttgaaaaccgactgtatctttaatgccgtgaaagagcggcgcaatgctatccggtagatcgccctgcccggtcgtcgaggtaacgaccagcgcaaccttatcctgatattgctgccagtcggacagttcaggatcttcaaacacggtcgcgctgtggccctgtctggcgaggatcgcttccgcttcttccgccaccagcagtgagttgccatacatggtcccgacaaaaataccaatttccgccattatgcgtatctccctgaattatgtcagatgagtctcatcctgccgggacgccgccgtaaactcaaccctttcattgtcagggagaagtccacgccagccaaactgcgtcagcgcctgcatccaggtttcatccaacccggcctgaattatcaacggctgtccggtgaaggggtgcgtcagttcaagacgactggcatgaagcatcaggcgacgacaggcaaaatgctctgcggcgctgcggttttgtcgcaaatcgccatgtttactgtcgccgatgataggatgacgcagatgcgccagatgacgacgaagctggtgcttgcgtcccgtttttggttccagctcaaccaggccataacgcgtggtgggataacgcccggtcggcaccgccatttcgaccgtcgccagcccgcgatactgcgttacggccggctggggcgctttatcttcgcgggcgaatttatcggcaattttatcgcgctcttccaccagcggataatccagtaccgcgtcatccatcagccagccgcgcacaatggcatggtagcgtttacggatgtggtgctgctcgaactgctgcgccagacggcgtcccgcttcgctggacagccccattaacagtacgcccgacgtgggcctgtcgagacggtgggcggtaaaaacatgctggccgatttggtcgcgcaccgtttgcatgaccacgactttttcgtcgcgatccagccagctccggtgaacaagccagcctgcgggtttattcacggcaaccagccacgggtcttgatagaggatctccagcatcaggatttatcgcgggcgaatagcgcatccagatcctgcaaaaccgccaggatcgtctcccgctgcggatgatccgccgccagcgccatttcataataaggggcgacggcaaacgcctcgggcagcggctgcgcattatcaagtagggtatgcatacgtgggatcaatacccattgcagccattccagcggctccatggtatccataaaaaatggttgggtgctggtaaacaggtgcgcctgcggcgcatcctgccgccagtggcgatgctcgcgcagcagcgtttcaagcgtatgtaactgctgacgcacacggtcatgagtcgtcatgttaaaaacctcaatgatgaaaatctggcgcgaagaataacaaaaaaaagggagcactgtataaacagtgctcccggttcgtttcgcagcattccagctacttttcgtgctccctgctcatccgtgacaacttttcctgtgaccttacggcctgttcatcctgaacgtttgcatcctgcgcacatcgcccgatgtgatagcttcttcctgaagcgtccctggtcatccagacccgccgaacatcctgatcggctctcgttctccgtcctggaggtgtcctttaacgcatcctgcgctttccactttgcttcatcctgaagcctttccttgtaacaccatcctggcgtgtcctgctgaagcgtcatcatcctgacgttcgcttcgttgtacgactccctgtcgacgaagatagaatcgcctgtttcaccttgtcttacaagacgcttacagacaataccttaagtaaattttcatatgaaagtgcgcaaaaacattttaattagttgttttatatagacttacataagaaaacggggctcagtatccgctgatatcctggcgatctcctacagactttgtaagagatctctcacacctgttagggcaaacgattacagaagaggattaagttgcgtaaggaattccgcaagcgttgcggcaagaacggtacgattgcgggtgcccagcgtttctttaatcacctcgccggacagattacagaccgaaatgacctcaagctcattttcctgcgtcgcaataaaaagcgtgggaggaagcttgagccgcttttgcgtgaccaggtggcctatcagattttcctgcacgcgccgaaagtcatcctgactccaggtttgcagtagcgtaagcttttcatccgcaaactgcgcgggcatgtcgccagcaaactgcgtggtgtaaaacgcgtggagcgcaggttgtaccataatatcaaaggcgcgttcaaccgcgtttacattttcttcgccttcaaaaggttgcggctgccagtaaacggcatcgcgggttgaagaaataatgcacggagaaggtacgccatacagttcttcgctcaacggccagctaccgtgtttttcttgccacgcatcgcagtaacgcgtcgtaaaggctttcaatgcctgcgctgtcagttcgtccaccagtttctctcttcataaaagccaggatacacttggcgcatagtgtatctggtttatgacggtgaaacatgtcttcttatgaaaaccatcaggctcttgatggcctgactctcggaaaatcaacggattaccgggacaattatgacgtcagcctgctgcagggcgtaccgcgcagtttgaatcgtgacccgctcggattaacagccgataatttgccgttccacggcgcggatatctggacgttgtatgaactttcctggcttaacagccagggtcttccgcaggtcgccgtcgggcatgtcgaactggattacaccagcgttaatttaatcgaatccaaaagctttaaactgtatctgaacagctttaaccagacgcgctttgacacctgggagacggttcgccagacgctggagcgcgatctgcgcgcctgcgcgcagggcaacgttagcgtgaggcttcatcgtcttgatgagctggaaggacagcctgtcgcccatttccacggcacctgtattgacgatcaggatatcagtatcgacaactaccagtttactaccgactatctgcaacatgcggtcagcggcgagaagcaagtagaggagacgctggtcagtcatctgttgaaatccaactgcctgatcacccaccagccggactggggctcgatacaaattcagtatcgcgggcgcaaaatcgacagggaaaaactgctgcgttatctggtctccttccgtcaccataatgaatttcacgaacagtgcgtagagcgtattttcaatgacattctgcgcttctgccagccggaaacgctaagcgtttatgcgcgctatacccgccgcggcgggctggacattaatccctggcgcagcaataccgatttcgtgcccgccacgggcaggctggcgcgacagtaatttttttgtcaattttgcgtgccggattgcgcatgtaaggttgtgaaaggtcatcagccagggctattgtaatcaacagggaatggcgtgttgcgtcccataaggagtttacttgattacacatattagcccgcttggctcaatggatatgttgtcgcaactggaagtggacatgctgaaacgcacggccagtagcgacctgtatcaactgtttcgtaactgttcacttgccgttcttaactccggcagcctgaccgacaacagcaaagagctgctgtcccgctttgaaaatttcgatattaacgtactgcgccgcgagcgcggcgtgaagctggaattgattaacccgcctgaagacgcttttgttgacgggcggattattcgtgcgctacaggctaacctgttcgcggtgctgcgcgacattctctttgtgaatgggcagatccacaatgccggccgtttccagcatctggatcttgaaagctcaacacatatcaccaatctggtgttctccattttgcgcaacgcccgggcgctgcacgtcggcgaagcgccaaacatggtggtatgctggggcggccactcaattaacgaaaacgagtacctgtatgcccgtcgcgtcggcacgcagttgggattacgcgagctgaacatctgcaccggctgcggccctggggcgatggaagcccccatgaagggcgcggcggtcggtcacgcacagcagcgctataaagacagccgctttatcggcatgactgaaccttccattattgcggctgaaccgcctaacccgctggtgaacgaactgatcatcatgccggatatcgaaaaacgcctggaagcgttcgtccgtatcgcacacggtatcatcatcttcccgggcggcgtgggtacggcggaagagctgctttatttgctggggattctgatgaatccagccaataaaaatcaggtgctgccgctgatcctgaccggaccaaaagagagcgccgattacttccgcgtgctggatgagtttattacccatacgctgggcgaagcggcccgccgtcattaccgcatcatcattgacgatgcggcggaggtagcgcggctgatgaagaaagcgatgccgcaagtgaaagagaatcgccgcgatactggcgacgcctatagttttaactggtcgatgcgtattgcaccggatctgcaggtgccgtttgagccgtcgcatgagaatatggccaacctgaaactgtacccggatcagccggttgagattctggcggcggatctgcggcgcgccttctccggtattgtcgcggggaacgtgaaggaggtcgggatacgcgccattgaagctaatggtccgtataaaatccacggcgatcgagagatgatgcgtcgcatggacgatctgctgcagggattcgtcgcgcagcatcgtatgaaattgccgggttccgcctacatcccctgttacgagatctgcgcttaacgcttatgcccggttgccgccagcagccgggcgcttctcccattcctttcattgcggtatggcgattcacgtatgccttcattttttatgatgatcatcagaggcatagcccgcattgttttataaacaccatttataattcaccataaatagattgccaggcaaacgtttacctgactcctcttaccgtgatttatcggttcaaactctcattcttcgcaagaatccactaaaaaccttgatttttatagtcaaacctccgtatcttgcgccccaatctttccggccttatatcgttaatggtagccttcgcgcccggaaattcgttatgacgtttttttaatagattaatggtccaaatttatccatgtaagaagcggattattgcatttgagatcgggatcactgatagattcatcacttaaatgtatctttccgcccgaaaattattacggcgaaaaattatataaaaagcgtccctaagcagatttcattttacgatcaggtcttttttcattggattagaccagcaacctgatttttagcatcctccaggagaaatagatggaaaccactcagaccagcactattgcttcgattgactctcgaagcgcatggcgcaaaacggataccatgtggatgctgggcctttacggcacggctatcggcgcgggcgttctgttcctgccgatcaacgcaggcgtcggcggcatgattccgctcatcatcatggcgattctcgctttcccgatgacctttttcgcacaccgtggtttaacccgcttcgtgctgtccggtaaaaatccgggtgaagacatcactgaagtcgttgaggaacacttcggtatcggcgcaggtaaactgattaccctgctttacttcttcgcgatttaccccatcctgctggtttacagcgtggcgattactaataccgtggaaagcttcctgacccaccagttagcgattaatccgccgccgcgggcgattctttccctgatcctgattgttggcatgatgaccatcgtgcgcttcggcgagcaaatgatcgttaaggcgatgagtatcctggtattcccgttcgtcgctgcgctgatgctgctggccttgtacctgatcccgcagtggaacggcgcggcgctggaaactctgtcctttgattccgccgcgtctaccggtaacggtctgtggatgacgctgtggctggcgattccggtgatggttttctctttcaaccactccccgatcatctcctccttcgcggttgcgaagcgtgaagagtacggtgaaggcgctgagaagaaatgttctaaaattctggccttcgcccacatcatgatggtgctgaccgtgatgttcttcgtcttcagctgcgtgctgagcctgacgccggcagatctggcagcggcaaaagagcagaacatctctattctgtcttacctggcgaaccattttaacgcgccgatcatcgcctggatggcgccgatcattgcgatgattgctatcaccaaatccttcctcggccactaccttggcgcgcgtgaaggctttaacgggatggtgattaaatcgctgcgtggtaaaggtaaatccatcgaaatcaacaaactgaataaaattaccgcgctgttcatgctggtcaccacctggattgtggcgacgctgaaccccagcatcctgggcatgattgaaaccctgggcggcccgatcatcgcgatgattctgttcctgatgccgatgtatgccatccagaaagtaccggcaatgcgtaagtacagcggtcatatcagcaacgtattcgttgtgattatgggcctgattgccatctccgctattttctactcactgttcagctaagtcctttagcgccgcttaccgcggcgcttctctatgatacaaccgcaatggatgccctatgattagcgtattcgatatttttaaaatcggcattggcccttccagttctcacaccgtcggaccaatgaaagcaggcaagcagttcacggacgatctgattgcccgccatattcttacagatgtcacccgcgtcgtggtggatgtctacggctctctgtcattgacgggtaaaggccaccacactgatatcgccattattatgggcctggcggggaatctgccggacaccgtcgatatcgacgccattccgtcctttatccaggatgtgaacacccatgggcgtttactactggctaatgggcagcatgaagtcgaatttccggtcgataagtgcatgaatttccacgccgacaacctgtctctgcatgagaacgggatgcgtattaccgcgctggcgggcgataaggtgctctacagccaaacctactactccatcggcggcggctttatcgtcgatgaagagcactttggtttgacgaatagcgaacccgttaacgtaccgtacccttacaaaaccgccgcggatttacagcgccactgccaggagacgggtttgtcgctctccggtctgatgatgcaaaacgaactggctctgcacagtaaagaagcgctggagcagcacttcgccagggtctgggaggtgatgcgcagcggtattgagcgcggtatcaccaccgagggcgtattgccgggcaaactgcgcgttccgcgtcgcgcggcggcgctgcgtcggatgctggtcagtcaggataagaccaccaccgatccgatggcggtcgtcgactggatcaatatgttcgcgctagcagtgaacgaagagaatgccgcaggcggacgagtagtcactgccccgactaacggcgcatgtggtattgttccggcggtgctggcgtactatgacaagtttatccgcgaagtaaatgctaactcgcttgctcgctatatgctggtcgccagcgcgattggctcgctgtataagatgaacgcctctatttccggcgccgaagtgggttgtcagggagaggtcggcgtggcctgttccatggcggcagcgggtctggccgagctgctgggcggtagcccggcgcaggtgtgcatcgccgcagaaatcgccatggagcataatctggggttaacttgcgatccggttgccggtcaggtacaggttccctgcattgagcgtaacgcaattgcttcagtcaaagcggtcaacgccgcgcgtatggcgctgcgccgtaccagcgaaccgcgcgtatgcctcgataaagtgattgagaccatgtacgaaaccggtaaagacatgaacgctaagtaccgcgaaacttcgcgcggcggcctggcgatgaagatcgttacctgcgattaattctcagcacattttaggatctgtaagccggataaggcgctcgccgccatccggcttttgttgcctgatgtcgcttcgcttatcaggcctacggatagcgctatttcgcaatgctcgcctccccccgccgtgaatgttaccctacgcgcaggtttgtaagggagaacaccgtggctgctcatctgcttatcgtcgacgcgctcaatttgattcgccgtattcacgccgttcagggatcgccctgtgtggaaacctgccaacacgcgctcgatcaattgattattcacagccagccaacccatgccgtagcggtatttgatgacgacgcgcgcagcagcggctggcgtcatcagcgtttgccggactacaaagcaggacgtccgccgatgcctgacgatttacataatgaaatgcccgccctacgcgccgcatttgaacagcgcggcgtacgctgttgggcatcagacggtaacgaagcggacgatctggcggcgacgctggcgctaaaagttaccgaagccggacaccaggcaaccattgtgtcaaccgataaaggctattgccagttgctctctccgggattgcgcattcgcgactacttccagaaacgctggctggacgcgccgtttattgaaaaagagtttggcgtacttccccggcagttgccggattactggggtctggcaggaatcagtagttcgaaagttcccggcgttgccggtatcggccccaaaagcgcgacccagctattgattcagtttcaaaatctggagggaatttacgcccatctggacgaggtgccggaaaagtggcgcaaaaagcttgagacgcataaagaaatggcatttctttgccgcgatattgcacgtctgcaaaccgatttacatatcgacggaaacttacagcagctacggctggcgcggtagttttgttgccggatggcggcgtgaacgccttatcctgcctacaggactgcacgaaatgtagagcggataagcgcagcgccatccggcaaaattaccaggcggtatgatacagttcgacaatgtccgccagactcgcttcacgcggattgccgcccgtacagacatcatcgaacgccgcctgcgccagcgccgggatatcctcttttcgaacgccgacatcacgcaaatgcagcggaattcccacatcgcgatttagcgtaaatacggcttccactgcggcattacgcgcctcttcaaggctcaatccttctaccttcacccccatcgcccgggcgatatcacggaatttctcgttggtagacccggcattgaaacgcatcacatgcggaagcaaaatagcattcgcgacgccgtgtggcgtgttgtaaaacgcgcccaacggatgcgccatcccatgcaccagccccagccccacattggaaaaccccatcccggcaacgtattgccccagcgccatcgcctcaccggcctctttttctccggctacggcgccgcgcagcgcgccagcaataatctcaatggctttgatatgtaatgcatccgtcagcgcccatgcggcccgggtaatatagccttcaatagcatgggttagcgcatccacgcccgttgccgctttcagcgcgggcggcataccgtccatcatatcggcatcgataaatgccgcctgcggaatatcatgcggatcgacacaaacgaatttgcgccgtttctcttcatcggtaatcacataattgatagtgacttccgccgcggttcccgccgttgtcgggatcgccataatcggcacgctgggtttacgggtcggcgatagcccttccagactgcgcacatcggcaaattccggattgttactgataataccgatcgctttgcaggtatcctgcggagaaccgccgccaatggcgatgagatagtccgcgccgctttgggtaaagaccttaagcccttcctggacaacggaaatcgtaggattagggatcacgcccgcatagatctcccacgccagccctgcggcatccattctgcttgtcactttatcgaccacaccgcattgcaccagcgttttatcggtaacaatcagcgctttatgataaccgcggcgcgtcacctcatcggttaatgcgtccaccgctccccggccaaaccatgccgtttcattcagaatcattctgttcgccatcgcctgtctcctgacatcactcttcaatacgtaatccgtaagttttaaatttctccagtacgatagcgatcgcctcgtcatccagtaccggtaccggatcgacaatggccagcgtacttaaatagagctgcgccagcacttccacttcatgcgccagccacaacgctttgtctaaattttcttcacaagcgataagcccgtgatgctgtaacagcgtcgctttacgatttttaagcgccacggcaacatggtcagaaagttcgcgggtgccaaaagtggcgtagggcgcgcagggaatagagtttcctcctgcggcggcaatcatgtagtgaatcgccggaatcgggcgattcaggatcgagactgccgtacaatggacagcgtggttatgtaccacggcattggcgtcagggcgcgtctggtatgccgccatatgaaaacgccactcgctggaaggcagcttgccctgctcatgctgaccgtcagcatcaataaagacaatgtgcgactctgtcagcttctcgtaggggatccccgtcggcgtaatcagcaatccgccctgataacgtacgctcacgttacctgccgtcccctgatttaaccctaaccgcgtcatttccagacaggtatcaataatctgccgcgccagtctatttcgttccattatttacctctctctgtgattcaaaatgagacaacaaaaccgcctttcgcattgcgctgctgtcctgttgaaataatcgaatagttagcaactatcatcatactgaataaagagaagggaatttaaataacgatattttgtgattcacatcaattaattcgccacgataaaccagacgactaccgtttctctcgccgataaatgcccgctcttaataatattttttaaaacgggcaaagatgaagaataagttactactgcccgttttcgtggcaataatttaattcgggcattcagcctgtggttttttaaattaaacatctcaaacggtcattttttatgaaaattaaagtgatgataatcacagaacgctatgctctcaggtataaatgtgaccgccatcatattaaaaggccttttttatttgaaaatgactccatgagttcattccggacgccaatttattaccggtaagaaaagcgaactcacctaattttacggtctggtgaccagaaccgaccgcacgcaaaagcttctgaaccgatgaggatgctatgggaaacacaacaatacaaacacagagttttcgtgctgtggatgcagagcaaagcaaaagcaagcgctacattattccattcgccttactttgctcgctattttttctgtgggccgtcgccaataatctgaatgacattttattaccgcagtttcaacaagcttttacgctaactaactttcaggccgggcttattcagtcagccttttatttcggttatttcgtcattccaattcccgctgggattttgatgaaaaaactcagttataaagcagggattatcaccggactttttttgtatgctgttggcgccgcattattctggcctgccgccgagataatgaattacacattgtttttaattggcctgtttatcatcgccgccggtttaggctgccttgaaactgcggccaacccttttgttacggtattaggtccagaaagcggcggacatttccggcttaatctggcgcaaacttttaactcctttggcgctattatcgccgttgtgtttgggcaaagccttattttgtctaacgtgccgcatcaatcgcaagaagcgcttgataaaatgacgccggatcagcttagcgcctataaacacagcctggtgttatcggtacaaacgccatacatgattatcgtcgccatcgtattagtagttgcgctactgattatgctgaccaaatttccggccctgcaaagtgacgatcatagcgatgctaaacaaagctctttcttatcttctctctcccgactcatccgtatccgccactggcgctgggcggtgctggcgcagttctgctacgtgggggcgcaaaccgcctgctggagctatctgatccgctacgccattgaggagatccctggaatgacgcccggtttcgccgccaattacctgaccggcacgatggtgtgcttctttatcggccgtttcaccgggacctggcttatcagccgcttcgcgccgcataaagtgctggccgcctacgccctgtttgccatgctcctgtgtctgatttccgcctttagcggcggacatatcggcctgctggcgctgacgttgtgtagcgcatttatgtcaatccagtacccgaccatcttctcgctgggtatcaaaaatctgggacaggacactaagtacggctcgtcttttatcgtcatgaccatcattggcggcggtattgtcacgccagtaatgggcttcgttagcgacgccgcaggcaaaatcccgaccgccgaactggttccggcattgtgctttgccgtcatcttcatttttgcccgtttccgttcacaagcggcgacaaactgaacatttatccgaataacgtgaggaatctgtcatgaaaaaaatcagcttaccgaaaatcggtatccgcccggtgattgatggacgtcgtatgggcgtacgcgagtcgctcgaagagcaaaccatgaacatggcgaaagcgacggcggcgctcatcaccgagaaaatccgccacgcctgcggggctcaggtggagtgcgtcattgcggatacctgtattgccggaatggcggaatccgccgcctgtgaagaaaaattcagtagccagaacgtgggcgtgaccattaccgttacgccgtgctggtgctatggcagcgaaaccattgatatggacccgatgcgtccgaaagccatctggggctttaacggcacagagcgtcctggggcggtttaccttgccgcggcgctggcggcgcacagccagaaaggcattccagcgttctccatttatggccatgacgtgcaggatgccgacgatacctccattcctgccgacgtcgaagaaaaactgctgcgttttgcgcgggcagggttagcggtagccagcatgaaaggcaaaagctacctctccgtcggcggcgtgtcgatggggatcgcgggttccattgtcgatcataacttctttgaatcctggctgggcatgaaggtgcaagcggtagatatgaccgaactgcgccgccgtatcgatcaaaaaatttatgatgaggccgaactggagatggcgctggcgtgggcggataaaaacttccgctacggcgaagatcagaacgcctcgcagtataagcgcaatgaagcccagaaccgcgcggtgttaaaagagagcctgctgatggcgatgtgtattcgcgacatgatgcagggcaacaagacgctggcggacaaagggttagttgaagaatcgctgggctacaacgccattgccgccggcttccagggccagcgccactggaccgatcaatacccgaatggcgataccgccgaagcgctgctcaatagttcttttgactggaacggcgtacgcgaaccgtttgtcgtcgccaccgaaaatgacagtctgaacggcgtagcgatgctgttcggccatcaactcaccggtaccgcgcagatattcgccgacgtgcgaacctactggtcgccggaagccgtagaacgcgtcaccggccaggcactcagcggcctggcggaacacggcattattcacctgattaattccggttctgccgctctggacggtgcctgtaaacagcgcgacagcgaaggcaagccgaccatgaaaccgcactgggaaatcagccaacaagaggcggatgcgtgtctggcggccaccgaatggtgcccggcgattcacgaatacttccgcggcggcggctactcatcccgtttcctgaccgaaggcggcgtaccattcaccatgacccgcgtgaatatcatcaaaggcctggggccagtactgcaaatcgccgagggctggagcgtcgaactgccgaaagcgatgcacgatcagcttgatgcccgcaccaactctacctggcctactacctggtttgcgccgcgtcttaccggcaaaggcccgtttaccgatgtctattcggtgatggcgaactggggcgctaaccacggcgtactcaccatcggccatgtaggggcggactttattactctcgccgcgatgctgcgtatcccggtatgtatgcacaacgtggaggaggcgaagatctaccgtccttccgcctgggcggctcacggtatggatatcgaaggccaggattatcgcgcctgccagaattatggcccgctgtataaacgttaatgcggcttaggccggtggcgcaggtttaccgggactacgggcgcgtgaaccgtaggccggataagcgtagcgccatcgggcggcgtttatggagttatctatgaaacaagacgttatcctggttctcgactgcggtgcgacaaacgttcgggcgatcgccgttgatcgccaggggaaaattgtcgcccgcgcctcaaccgctaacgccagcgacattgccgcagaaaatagcgcctggcatcagtggtcgctggacgccatcctgcaacgtttcgccgattgttgcaggtcactctccagcgccctgtcggagtgtgttgttcgcggtattacggtgactacgttcggcgtcgatggcgcgctggtcgatgcgcagggcaagctgctctacccggtcatcagttggaaatgcccgcgaaccgctgccgtgatggaaacgattgagcgctttatctcgccccggcaattgcagacgctctccggcgtcggcgcgttcagctttaacacgctgtataaactggtctggcttaaagagaatcatccgcgcctgctggaacaagctcactgctggctgtttatctcgtcgctgattaaccaccgtctgaccggcgagtttacgaccgatatcactatggcaggcaccagccagctcctggatatccatcagcgcgactttagtccggaaatcctgcaggcgacgggcctggcgcgccgcctgttcccgcgtatcgtggaagcgggcgccccgataggcacgctacagacagacgcggccaggctactcggtctcccggcgggtgtgccggtgatctctgccggacacgatactcagttcgcgttattcggcgctggcgcgcagcaaggtgaaccggtgctctcctccggaacatgggagattctgatggtgcgcagcggtcaagtggatacctcgctgctcagtcagtatccgggctcgacctgtgaactggacagtcagtcggggctttataaccccggaatgcagtggctggcctccggtgtactcgaatgggtacgaaaactgctgtggacgccggaaacgccatggcaaacgctgatcgacgaagcgcgcgctattcccgctggcgcggaaggcgtacggatgcagtgcgatctgctcgcctgccaaaatgcaggctggcagggcgtgacgctcaataccacccgcggccatttctatcgcgccgcgctggaaggcctgacggcgcaacttcagcgtaatctgcgcacgctggagaaaatcggccattttaacgccacagaactgttactggttggcggcggcagtcgcaacgctttatggaatcaaattaaagcgaatcagcttgatatccctatcaaagtgctggacgacgcggaaaccaccgtggccggcgctgccatgtttggctggtacggcgtaggcgaatttagtagcccggaacaggcgcgcgcgcaggtcaattatcagtatcgttatttctggccgcaaaccgaacctgaaattattgagggagtatgaaatgctaaaaaccatttcaccgttaatttccccgacactgctcaaagtgctggccgagatgggccacggggacgaaatcattttttccgacgctcactttcccgcgcatagcctgggcccgcaggtgattcgcgccgatggtcttagcgtcagcgatctactgcgggcaattattccgctctttgagctggatagctacgccccgccgctggtgatgatggccgccgtggaaggcgacacgctcgatcccaacgttgaagcgcgctatcgcgatgccttgtcattagaagcgccgtgcccggatatcgttcgtatcgaccgctatgcgttttatgagcgggcgcaaaaagcgtttgcgatcgttatcacaggtgagtgcgcgaagtacggaaatattcttttaaaaaaaggggtaacgccgtaatctcttgccggtgcgcccgcatgacgcgggcgttcatcgaatgatggggtgagaaaaatgaaagcggcacgccaacaagcgatagtcgatctgctgatcaatcataaaagtctgaccaccgaagcgctggccacccggcttaacgtcagtaaagagaccatccgccgcgatctcagtgaactacagacgcagggaaaagtgctgcgtaatcacggacgagctaaatatattcatcgtgaaaatcaggacagcggcgatccattccatatccgcctgaaaagccattatgcgcacaaagccgatattgcccgtgaagcgttagcgtggatagaagaaggaatgacgattgcgctggatgccagttcaacctgctggtatctggcccgccagttgccggatattcccattcaggtttttaccaatagccatcctatctgtcaggagctgggaaaacgcgaacgcattgcgctgataagttccggcggccagcttgaacgtaaatatggctgttatgttaatccgtcgcttatctcacagctaaaatcgcttgatatcgatctgttcatcttttcctgtgaggggatcgacggcggcggcgatctgtgggactccaatgcgatcaacgccgattttaaatctatcctgctcaggcgcgcctcgcagtctttattattgattgataaaagtaaatttaatcgttcaggagaggcgcgcatcggccatctggatgacgtgacgcatattgtttcagatgcgccgcaatcgtagaccggataagcgtgcgtcatccggcgctgatgacgcgccggacgacggcaacgcgtttttatcgctcgtcgcgacgtccgccaacagccgcccacaaccgacgcacgtgtaccgtcacttcttcgcgatcgtgataaagctgacgcgcctggatctgcgcattaacgccgtgctcatccaactgcgcctgaagatacgccaggttatgcgacacctcttcatagcgttttttcatcggcagtttaaggttaaaaatcgtctcccgacaccagccgttcaccagccactgcgccattaacgcggtgactttggccggcttctccaccatatcgcagaccatccatgaaatattattccggttcggacggtacctgaagccatcctcacgcaaccaggtcacctgtccggtgtccatcaggctttgcgccatcgggccgttatctacggagtagacccacatattgcgcttcactaactggtacgtccatccgccgggacaggcgcccaaatccaccgcatacatgccgttcgccagacgttcatcccactcatcttccgggatgaaaacgtggagcgcctcttccagtttcagcgttgagcgactcggcgcatcagacggaaacttcaaacgcgggatgcccatataaaacggtgaattgttatgcgcgaacgaataaccggtatagcagcatcctggcgcgataaaaaagacatgaacgaccggacgcttcggcgtttcataattcgtcaatacgcccgcatcacgcaaagccgcgcgcagcggcaccgtaaatttgcggcagaacttcatcagttctttactttcattggtgtcggcgacttcaactcgcagctcgccgcccttttccactacgccctgcaacatgccgacaatcggcgtaattctgtcttccggcggtaaatgttgcagcagttcacccaccacaaaccactggcgggcgaaaatcagcgaactgaacggcagttctgaaatcagcttttcgccatcttccggctggtagcattcataaatgacatagcctgcgttctcttttacgcgtgcaaaaccaaatatttcccgttttcccgctttatcggtaatttctgcagcgcactctttttcaaaccccggacggcagagcaatacaactttattcatggctcgcgcccttacgtttcatacgaatggcgccaatcagcaatagcgcccagcccaccaggaaactgacgccgccgacaggcgtgatatacgcccacaggcgcagatgcgaaagcgcaaggcagtacaggctgccgctaaacagcaccgtgcccagcgccagaaaaacgctgctccagtaaaaccagatgctgatacggcgctgcatcgccaccgccaggccaaagatcgccagcgtatggaacgcctgatattgcaggccggtctgaatccagcccatttcaaccacgcccagggttttactcaaaacatgcgccccgaacgcgcccagagcaacgtaaataaaaccgctgatagcggcgacaatcagcataaaacggctggtcatggtcataccctaagttaattattgttcgtaacgaaaacggaatttttcttgctccgtcgccgccttcgccaaaatccactgacggaaggcggctattttacccagttctgcctggctgtcatgacaaaccagataaaaagcattcttactcaccagaacatcgttaaatggacacaccagtcgcccggcttcaatttccgactgcgccataacattattcgccagcgcgatcccctgtccgtgaatagcggcctgtagcaccatcgcgctgtggctaaatatcggcccttgctgaacgttaatatggttgagccctaactgacgagtataggcctgccagtcacgccgggaggcgtcgtgcaatagcgtgtgtttcgccagatcttccggcgtttttaacggtttttcgcctgtgagtaataaaggagaacagacgggcagtaaatattctgcgtataatttttcgacgcgcaagcccggccagtttccccggccataaaaaatcgcgacatcgacatcgtctgccagtttatcttcctgacggtcaacggcttgtatccgaacgtcaattcccggataagctgagttaaagctggagagcctgggcaccagccactggatggcaaaactgggcggtaaactcaccgtcagcgcccctttggcactgcgcgcctggagcttacgcgttgcttccgtgagctgggaaaatatctctttaatgtcgagaaaatagctttggccttcttccgtcagcagcagcgaacgattgcggcggcggaacagttttagccccaaaaaatcctcaagtgacttaatttggtggcttactgcggcctgcgtcacaaaaagttcttccgctgctcgcgtaaagctcaaatgacgcgcggcagcatcaaaaacgcgtaacgcatttaaaggaggtaatcgttttgacatggcctctggacttaatgtcgaatgaatttaacaaataggtaacaacatgtaacctattagtttttttaatctgagacattataaattgtccgttgaggttctaccagcaaatacctatagtggcggcacttcctgagccggaacgaaaagttttatcggaatgcgtgttctgatgggcttttggcttacggttgtgatgttgtgttgttgtgtttgcaattggtctgcgattcagaccacggtagcgagactaccctttttcacttcctgtacatttaccctgtctgtccatagtgattaatgtagcaccgccatattgcggtgcttttttttgtataacaaacggttagttttccagagccaccatctctttcacgtcagtacgattgatctgctgtttgttgccattagcgtctttatacgaaatcataccggtatcgttatcggtctggggtttaccgtcggtcacaatgctacgtccatcattggtgtgcataacgtaattaggaccggaacaggcgctcagggcaaaagtcagcatacatgcagagataattgcggcagtctttttcatcttcttctccttaaagctgtttgtgctatttaaagcggactccgtaacaggcttaaacattcgcctaacattattcagcataacctcctttacataattcgccaggatatacagacgattccgatggttaggacaaaccttgtatcagccgcgcttttacgccacgatcggtaaactgaaccgaggaatatcatgaacgcttttaatcccacgcagtttcgcgcgcagtttcccgcgctagccgatgcgggtgtttatctcgatagcgccgccacggcattaaagccacaggcagtcattgacgccacgcaccagttttattgtttgagcgccggtaacgttcatcgtagccagtttgcgcaggcgcagcgcctgacggcgcaatatgaagcggccagagcaaaagcagcgcggctgttaaacgcgcccgatgaaaaaagtatcgtctggacacgcggcaccaccgaagcgatcaacatggtggcgcagtgttacgcccgtcctcgtctgcgccccggcgatgaaattatcgttagcgtcgccgagcatcacgccaaccttgtgccctggctgatggtggcgcaacaaaccggcgcgcaggtcataaaactgccgcttaatgaccggcgtcttcctgatgttgagcgtctgccggaactgatcacgtcgcgcagccggattctggcgctggggcaaatgtcgaacgtaacgggcggctgcccggatctcgcaagcgctatcagcgccgctcacgcagcgggaatggtcgtgatggtagatggcgcgcaaggcgcggtacacttcccggcggatgttcagcagcttgatatcgatttttatgctttttccgctcacaaactgtatggcccgaccggtatcggcgtgctgtacggtaagccggagcttcttgaggcgatgtcgccctggctcggcggcggcaagatgatccgtgacgttagctttgaaggcttcaccactcaaagcgctccctggaaactggaagcggggacgccgaacgtcgccggggtcatcggcctgagcgctgcgctggaatggctgtccgatatcgatattgaacaggccgaaaactggagccgcgggctggcgacgctggcggaagacgcactggcgaaacgcccgggctttcgttcgttccgctgccaggactccagcctgctggcctttgattttgtcggcgtgcaccacggcgatatggtgacgctgctggcggaatacggtattgcgctccgggccgggcaacattgcgcccagccattgctggcggaacttggcgtcacagggactctgcgcgcctcttttgcgccgtataatacccaacatgatgtggatgcgttggttaacgccgttgaccgcgcgctggaactgctggtggattaatgacaaaccctctttataccggacacccgttcggcacaacggtaacggaagagacgttacgcgctatctttctcccgctgacccagtgggaggataaatatcgtcagttgattctgttaggaaaacagctccccgctctgccggatgaatgcaaagcgcaggcgaaagagatagccggctgcgagaaccgcgtctggctgggctttacccgatcagataacggaacgatgcactttttcggcgacagtgaggggcggattgtccgcggcctgctggcggtattgctcaccgcggtggaaggaaaaaacgccgccgagttgcaggctcgttcaccgctggcgctgtttgatgagctgggtttacgcgcccagcttagcgcctcacgtagtcaggggctgaacgcgctgagcgaagcgattgttgccgcaacgcataagggttgaaatagcgtaaatattctgtcgcctgacagcgccgcccgcagcggtcaggcgatgcagataaaataatccagtcactttattagtttcggcgtcagatttccctgataagcattcttttgatttttatcagctatcacaatgaaattacaatgttagaatccatgttaaaacggcgtgaagattttagagtaaataaagccactcgatgtagcgtagcaggagaactggaaaattcatacgcatcgggtgaagttataacaggatatggataagtggaaaaatatctgcgtagcggtaccatgtttgtggtactggcatttatattatgggggttaacacctttatattatcaatatttatcaggggggaatctcgcacaaatattgatataccgggtgttctggtcaattccattattactggcagtaagattgttatttcggcagcgaacgcgatttcatgatgcctggaaagataaaaaatcttttttcttctgcatgatcgccggacttttgatgattgtctcatggtcatcttttatttatgcgctaacccatcatctggtgcttgatgccagcctcggctattttatcaacccgctatttgttattgcgctgggatgcatttttcttaaagaaaaactgtcgttgtttcaggccatcgccgttttttccggtgtctgcggcctgacttttcaaattatcatgctacggcatttcccggcgctggcgctaaccatgggattatcatttgcgctatatggcctggcgcgaaagtttatacattatgatgtgatgacatcgataacgattgaaacattatgggcattgcctgtctcactattaatttttctctttagcgatactggaccaattatatccgctaatactcctttctttttgtatgtcatgacggcgccagtgacgatcattccactggtattatttgccatcgcgttaaatcacacctcgttgattgtcaccggactggcgcaatatatagagccgtctttacagttcttacttgccattatgatatttggcgagcacattaattacgcggaactgctctgcttttgtgcagtatggttcgggttgtttctatgcatatctgaaaatttatattcccattatctccgcgcccgtctgaaaccggtgttcggcagggtacagcgcttctttcgctaacgaagggcgcagggccggatacgcgtctgcgtgacactccgccccgtccttttattcttgtcgcgccgctttagccatgatcttcttcagcgcatgggaaacggcgacaaaaccgaacgttgccgtcaccatcgtcgccgcgccgaagccagaggcgcaatccatccgttttggcccttctgcggtagctttcatcgcgcatacggaaccgtccgcctgtgggtaaaccagcgcttcggtggaaaaaacgcagtccacgcccagcttacctttactgttcttcactacgccaaaattatgtttcaatctctcgcgcagttttgccgccagcggatcctggatggttttcgccaaatcagcgacctggatttgcgtcggatcgatctgcccgcccgcgccgccagtggtcactaaaggaaccttatatcggcgacagtacgcaatcagcgcggcttttggacgaacgctgtcaatagcgtcaatgacataggtaaaacccgcgttcatataacccgccacattatccggcgtgatgaaatcatcgataaccgttacccggcactccgggttaatttgccgaatccgttcggccatcacttccgctttcgccaacccgacgttatcacgcaacgcatggatctgacggttcgtattggtcacgcagacatcgtccatatcaatcagcgtaatcgcgccgatgcccgtacgcgccagcgcctctgccgcccatgatcccaccccgccgattcctacgacgcagatatgcgcctcagcaaaccgctgcagcgctttttcaccgtacagacgcgcggtgccgccaaagcgttggcgccaggcatcacttatcaccactgacatatgacctcagaataaaaaaaggtgaggttattcctcacccctgctcactattttcaggcccgatagcgatcgcgttatcgggcaatccggttgtcgcagaataccacaatcagccgctaaacacgttaccggcgcccggcgcgctttttaacacccagacgcgaccatagtgattataccatccggcacgatgcccggcatccgggccaattccctggtaaatatcaaagtgctggcctttaatcgctccgccgacatccagtgcgaccatcaaacgtagctcatactgaccgctaaatttaccgttgttatccagcaacggtacttccgccaacaaggtcgtgccaggcggaatgatgctgcggtcggaggcgacggatgctcgcccaatcagcggtacagcgctggcgcctttgaccggcgcaaaagattgcggcttaaagaagacgaacgacgggttctgctccagtaattcacgcacttccgcttcgctgtgcttctctccccattcgcgtatagcctgcatcgacatatcttcttttttcacttcaccgcgatcgataagcactttaccaatactgcgataaggccagccgtttttaccggcataactaaagaagttcagcggactaccatcaccaaaatcaatataaccgctgccctggacatccataataaagttatccatcagcgaattactccaggccaggatgtacttatcgctcagcgcgcctgcgtagatctgagcgcgggacggtaagcgtccgcgttttggcggcatactatagataggatactggaacgcgccctggcgcgtatggcgagcctgaacgacgggcgtatagtagcccgtgaactggacgttaccgtagttgtcggtgccttccatctgccaggcatcgataccaaactgacgcatagtgcgcgtatcgcctccggaacgtaaccagttctggacagcgttatagacgttgctttgattggtgtataaacgcggcgacgcggaacggatctggttgacctgctcggcaaagtctccagcattaatcggcgcgcccactgcgtccggctggtttaccagggagaagggctgggtaaatttcccgtccttatattgctgaccgcgatcggtcggttttgatgaacaggcagccagcattgccagcattacgcctgtcgccacatattttgcccaacgtcctttcatggtgtctcgtcttctgcgtaatcgaaagtgcccggtgaagataacaaaccgtccgaagtaatgaaatgcgatcgcgatctcattatgtaaattcgtttaaaaatcgcgctatctgcggtgtatttgcgcaattcatgagaaattagcgatttatatgaaaaaagggttgcaacaaaagctcagcggagtatagtgcgcatccacggacgcggggtggagcagcctggtagctcgtcgggctcataacccgaaggtcgtcggttcaaatccggcccccgcaaccaattacaatgagaatgcaagtttagacggacgcggggtggagcagcctggtagctcgtcgggctcataacccgaaggtcgtcggttcaaatccggcccccgcaaccaacttaatgaacacccttacgggtgtttttttgtatctgtcgtctggtccgcaacgacagtgcgggcagcatcctacttacccgcgcaataaactcgccgtcatctcaggttaacttcttctcgccagcgtcgccccatcggcaaaatacgctttaatgcccgccagaatcgactctgcgacctgttgctggaacgtcgcggtcttgagcttgcgttcttcttcaatgttactgataaacgccgtctcgaccagaatagacggaatatcgggcgcctttaacaccgcaaaccccgcctgctcgaccttgtttttatgcaggtcattaattttaccaagctgcttcaacaccgctttaccgaatttcaaactatcggcaatggtcagcgattgcaccatatcgaacatcgtatggtcgacataacggtcaccgcttttgctcacgccgccaattaagtccgaggcgttctgcgtttgcgccagatatttcgccgcagtactggtggcgcctttggtcgatagtgcgaatacggatgaaccgctaggctgccggctggtgaaggcatccgcatgaatagagacaaacaggtcggcgcgctgtttctgcgctttcgccacccggacttttaacggaatgaagatgtcttcattgcgcgtcatatagaccttcatgttgccttctttttcgatcaacgcgcgcaggcggcgggctatctggagcaccacgtctttttcacgcgttttgtatttgcctatcgcgccggggtcttcgccgccgtgtcccggatcaagcataataacaatggggcggtcgcgccccgctttaccgggctgcggcccgctttgcgaaggcggcacctgcttatccagatcgcctttattgtagtcttccagcagcgccagcagcggatcctgcatatcctgcgcattggcaggataaagatccatcaccagacgttctttaaagcctgccacaggcgccagcgcaaatagctgcggcttcacgttttgttttagctcaaagaccatacgcacagtcttaggatcaaactgccctacccttgcggatttgatatacggatcgtcgctgcgaatctgcgcgccaatgcctttaagcaccgagttcagattcacatcctcaatatctactaccacgcggtccgggttacttaaggcaaattgtttatatttcagcagacgattcgactctaccgtgacgcgggtatagctggacgcaggccagatacgcaccgcaacgacctggcttacggcagccagcccgacctggctcacgcttaatagccacatggcgcccgcgccttgtagtaaacggcgacggctgattgctgaattggctcccgacatgcttctcccgagcaaaaactaaatagagatcatacaaagttcatccaaattgaccggaaactttagcgaatgacgcataatctgtcatctataaaagggtaaacattctttttatattcacggcattactaagaaaagcgatcggaccgcataaaatttacgcttgcacagagggcaaaaacagaataaaaatacactaatttcgaataataattcactagtggggcgcgcaatgataaaggaacgtaaaaccgaactggtagaagggtttcgccattcagttccctatatcaacacccatcgcggaaaaacctttgtcattatgctcggcggcgaagccattgagcatgacaatttttccagcatcgttagcgatatcgggctactgcatagcctcggtattcgccttgtcgtggtgtatggcgcgcgaccgcaaatcgacgccaatctggccgcgcatcatcatgaaccgatttaccacaaaaacacgcgggtgacggacgccaaagcactggagctggtgaaacaggccgccggtttactccagcttgatattaccgcccgtctgtcgatgagtctgaacaatacgccgttgcagggcgcgcacattaatgtcgtcagtggcaatttcaccattgcgcagccgctgggcgttgatgatggcgtggactactgtcatagcggccgtatccggcgcattgatgaagatgcgatcaaccgccagttggataacggcgcgatcgttctgatggggccggtcgccgtctcagtgaccggcgaaagttttaatctgacctcagaagagattgccactcaactcgccgttaaactgaaagcggaaaaaatgatcggtttctgttcttctcagggcgttaccaatagcgagggcggcatcatttctgaactcttcccgaatgaagcacaggcgcgggtggaagagttggaagcgcagggcgattacaactccggaaccgtacgttttttgcgcggcgcggtaaaagcctgtcgtagcggcgttcgtcgttgccatctgatcagctatcaggaagatggctcgctattacaggaattgttctcgcgtgatggtatcggtacgcagatcgtcatggagagcgccgagcagatccgccgcgccaccatcaacgatattggcggtattctggagcttatccgcccactggaacagcagggcattctggtacgccgttcccgtgaacaactggagatggagatcgataaatttaccattattcagcgcgataatatgactatcgcctgcgcggcgctgtatccttttgtggaagagaaaataggcgaaatggcctgcgtagcggtacatccggattaccgcagctcatcgcgtggagaagtgcttctggagcgggttgccgcccaggcgcggcaaatggggctgcgtaaattgtttgtgctgacgacgcgcagtattcactggttccaggagcgcggttttacgcctgtcgatatagagttactgcctgagagcaagaaaaaaatgtataactatcagcgacgttcaaaggtgctgatggcagatttaggataacaaggggggcctgatggcgctgcgcttatcaggcctacgctcgaaagcatcatttggaggccggataagacgctacgcgtcgccatccggcgagaactcgtcttatccggtacgactgacttcatcaaataaggtggctagcccgctgcgccgctccgtacgcgtcacaatcgcgcctgccaggatccgttcatcggcatacagcgataaccgccgccgcgctcgcgtaacagcggtatacaccagctcccgcgtcacgaccggcgaacgctggctgggtaaaatcagcgcggcgtgatcaaattcagacccctgtgatttatgtaccgtcatcgcccaggttgtatcatgttccggcagacggctgggctgaacggacttgatcgtgccgtccggcatcacaaaccagacgcgtaacccctgcccgcgatcgagcgcaataccaatatcgccgttaaatagccccaacgcgctatcgttgcgcgcaatcattaccggacgcccttcgtaccagcgagaatgcgggtgccgctgaatttttcgttgctgcaccatcgcctgctcaatgcggtcattcaatcccctcacgccaaatgggccttcgcgcagcgcacaaagcagttgatactcattgaaagcctgaaggattgcctccggcgtcgctttttcatgcagcaaccgcaggtagcgaccatagcccgccagcgcttcatccagcatcccggcataatcgtcgctgctttgcaatgtacgcttctctatatcgctaaacccctgctgaaaaacagcctggattgccgacctgtcgccgcagttaattgccgccgccagcttgccgatgccagaatcgctgccgaaacgatagctcttttgcaacaaacagaggctatcgcgtaaagatgcggcttgcgttccggcccccgccggaatggcgctaccagtgagtcgacttagctgtcgggcgcgttccgccgtaaaccctgcgttgacataggcgcaaatatcgcccaacacagcgcccgcctcaacggatgccaactgatcgcgatcgccaagaaaaatgacccgcccgtgcggcggcagagagtcaatcaaacgtgacatcatcggcaaatcaatcattgatgcttcatcgaccaccagcacgtccagatgtagcgggttgcccgcatgatggcgtaatcgttggctgccgggctgtgcgcctagcagtcggtgcagcgtactggcgtcctccggtatacgctttttctgcgcatcggtaagaggaagctgacgcaacgccgcgccgagcgactccgtcaggcgtgcggccgctttcccggtcggcgctgccagccggatacggcaacgttcgccatccgccatttgaattaatgccgccagcagcttcgcgacggtggtggttttaccggtgccgggaccgcctgaaatcacggagatacggcgagttagcgctacggcggcggccaccttttgccagttcacctcgtctgtcggagggaatagcgcgtccagaatacgggataactgatcttcatctacggcgatggcctggttaacctcgttaaaaaagcgcgcaaccgtacgttcgttgcaccacatgcgattcaggtagagacgctcgccgcacagaattaacggcgcggggctatcgccgcagctaaccgccgcagacgccagtaaccgctttttccagtcgattggcgtagccgtttcgcttatacaggcgaccagtaagggatgcgcctcctccgttaacgttaaacgcgacaacggcagacacacgtgaccttcacctgcgtcatgactaagcagcgctgccgccagcgtcacggcgggatcgtcgttaccggcgacggttaaagcaaactgggcatcaatgggccgtaagagtttttgttcaacggcctccagcaaccgctcctggattgtcattgcgcctcctcactcatttcacctgcaaacatatcatccagttggttaattaacgccgccgcaggacgagtggtaaaaataccctgctgcggacgttcgccatccaccccgcgtaaaaagagatagatgacgccgccgaaatggcgttcatagtcgtaattcgtcattcgatgacgaaggtaacggtgcaatgccagcgtataaagctggtactgcaaatcatagcgatgcgcctgcatcgccgcagccatcgccgtctgggtataagcggcgctatcctcgcccagccagttagatttatagtcgagcaggtaatagcgcccttcataacggaacaccaggtcgataaagccctttaacatgccgcgaacctgcatgaaatccagcgcagggcaacctgctgaaagcgggtcgtatcgacgaatcaacgcatccagctctccggcggtaagcggctgggcaatcggcagataaaactccatttcgacctgtttttcacgctcggtcagcacgctcagactaacgcccgtctcgttaaggggaacgtgtaacacggtgtccagccagcgggtaagtacgggctcccatcgcgtttcaaaaccactcagctccagtttttcctgtacccattgggggtttatcggttgagtaaaatcaagctcttcaaacaggctgtgcaaaaatgttcccggcgatgccccgcgaggaaagtgatgcggcgtcattgccggcgcttccgccgcttcgccaacgcctgcggcgtcaatgtcgagacgaggaataagatcttgcgccacgctatgtccccgctgctgcaaaccggaataactggtgacgcgccagctatcataaagcaggcgttgcagcgctctggcgctgagttccgcatgcgatgcagcggcaatttgccagcgatcgttatccgtgttgcctggcgttcgacacacgatatcctcgtcgcatagcgcctcaatacaggcgcgaaggcctgcggcatccatcggttcgcctttttgcaggagtcgcccaagcgcgctttggtgcacatccgtctcgcctttcttatcgctgcgacgccgtaccagcggcgcgacgccgaggctgcaatgccacactgcacgggtcagcgcgacataaagtaggcgcaggtcttccgccaggcgttcggcttccgccagtgctatgctctcttcggcgtgactaaggtccagcaccgcctcgtaggagtgcctgtcgtgataaaaagcctggtcctgcacgcggaaatgggtgataaaaggtaaccagaccagcgggtattccagacctttcgatttatgaatggtgacgatttgcaccagatgcttatcgctttccagacgtagttgctggctggaagcattgctatcgggttcaaggatatgttgcgccagccaacgcaccagcgcatgttcgctttccagctgcgaaccggcttcctgtaacagttcgctaatatgcagaatatccgtcagccgacgttcacctcccgccgtcgccagcaggttttcagcaatattgcgcgccgacattagcgcgcgcagcataggcatcacgccgcgtttatgccaaatctgtcggtagccatcaaactcttcgacaaccgcatcccacgcattttcatcattgttaagcgtttcgatatccagcgcggtaaggcccatcattgatgtcgccagagcgctacgcagcgtattctcacgttcgggcgccatcaccgcctgcaacacccacagcatttcctgcgcttcgagcgtttcgaatacgctgtcgcggtttgaaagatagacggaagggatcgccagtaaggtcagcgcatcccgtatcagcgcggcttcccgcctgctgcgcaccaacacgctgatatccgaggcgcgaacgggccgcgacgaatcgccgttcgtcagcagcgcgtcgcccgtttgcccggcgcgcagccagtcgcgaatttgcgtggcgcacacctgcgccatataactttgataatcgcccgaaccgcagctttccccctccattagccacagggtcatcgccggttgaggcgcgtcattcactttaaattgcagcgactggtttctgggcgcaaactttaccggactgaagggaatatcgcggaacataaaggcgtcattcatctgactgaacagcttgttaacgctattcaccatccccggcgcggagcgccagttagtgtcaagggtatagtgcgcgctcacttcgctgcgagccttcatgtaggtaaagatatccgcgccacgaaacgcataaatcgcctgtttaggatcgccaatcagcaatagcgccgtatcgggttgatgtcgccagatacggcgaaaaatacggtactgttgtgggtcggtatcctgaaattcatcgatcatcgccaccggaaaacgggtacgaatcgccgcagccagcgcctcgccgctttcactacgcagcgcggtatctaaacggctgagcatatcgtcaaaccccagctcgccgcgccggcgtttttcctgagccaccgtttcacggatctctgatagcgctcgggtaagaaccagatctttaatcgatagcggttcgcccaacaggttatcaatggcgacaaacaatgggtgctggggcgtcacgccgccagctttggtgcgctcagctaaaaaacgctgtgaaaattttcccaacgcctcgggtaattgatagtttttcgtctcttcttgcgcccacgcggtgatcttttcgatccatttcgcctgattgccgcggttgaattttctgcgatcgatgccggatgattcgatcagcgcgtccagctcgctaaccgcctcacaccactgctgcttcacctggttgatgcgcgccaggatctgttcatggcgcgatgccagcgtctcctcctgcgatggcggcgctttaatgaccggcgcttcgccctgcagataacgatcgatatcctttaagagcgccttcggtcccttccacacgtcaaacaccacctgcgcgatgtcgcgcggcagcggatagcaatgacgccgccagaaatcggcgcaggcctgataacgcaacaaagattcgtcttcaataagctgttgctcaaacaacataccggattcgaaagcgttcaggctgagcatacgctggcaaaaaccgtggatggtaaagaccgcggcctcgtccatttgtcgttccgccagtaataaccactgcgcggcctgctttttgtcgctaatttcttccagcaagcgggcataaagcggattatccgtgctttcccgcagacaggcgatgcgcaactcatggatattactgcggattcgcccacgcagctcttcagtggcggcctccgtaaaggttaccaccagcagttcttcaacggtcaacggacggggaaatgcggcgctgccgcctaaaccgagcagtagccgcagatacagcgccgcgatagtaaacgttttgcctgtgcccgctgatgcttcaatcaaacgctcgcctgtcaggggcaagcgcagaggatcaagagtctcggcgacatcattcattcttttcgctcattagaggtaacgtttgctgcaaagcgctgacgttatcccacactttccagcctgtcggatgcacgtattctgcttttccattctggctaccggcaatctgtgacaatattgccataccttgtggttccaccaccgcctggtggaagaaatcggcaagcttttgtggcgtcagcaattttatctgagcgatgattttatcacgcgagtcaaagcgcatattaccccgatcgaaatccttgcttaaacgggatgcttcttcgcccaacgtttgcggcgcctggcgcatttgcgtaatgatcgcctgctgaatttgggcgaactcttccggcttcatcgccctcagcttcgcctcggcgtcagggaaaaatgcctgatagcgttgccacaggtaagagggctgtttatcgttgctctgtagcaggaaccccattccccactgacggccaacgctcatcggaaaggcgaaaacggcgtatcccagttgctcttcggttcgtagctgattgtaaaaccacggttgaacaatctgacctaacatcgcgctgtaggcagcgctgacgtactcgtcgtagccgaccggaacaaagaccgcggctaacgcggagtcggtgctactgcccgctttttcaaatattacggactgctttttctcaaccaccacgtctttgttgcgacaccacgccgatccgttcgccgcgagctgtttttgaacatcttgcgccagagaggtcgcctgggcttcgctcatattccctataaccagaaattccggacgagcgcccgtttttaacgcattacgataggccattacctctttcaacgtaatggacggcagcaaagcgcgacgttcatcacgggaaaaataaggcacctgcgaaatcatctgcaccggcataatcgcctgctcgtaggcttttcccttctccgcagaatccatcatctgcgtataccaggatttcgcctgcgccagctgttcctccgtggcgtcgtagctaaaatatccttccagcaacgccaggaaaagctgcggcaaacgctgggtataaccgttcgcagtgaccatcagaccattgttggcgttagtagaaaagctaatgccgcccactgccgcctggttgctgagctgatcgagcgccattcccgccagataatcattaagggcgaacagtacctgattgcgggcgctgtccatcgcctgcgggttacgcaataccacgctcacgtcagcttttggctcgctggcgaaataacgactcggcgcataaaccacgcgcaaatccgctttatcgacaatcagttctggccgcacgtagtttttgtcattcttaacaagcgtaaaatcatcaggaatataggggtttaactccggcagcgacaacgcaatgccctgtgctttttgctgccagtttttaaacgtctgttcgctaatcttatcgacctgataaggcgcatccacaaaatacgccgtcttattatggggttcctggggactgatgtaccagatgcgcgcattctgcggcgtcatcatcgccaggcgatttttgatagcggcaggatcgtaacgatcggcgatattcgccgcatccagcgtatgcgctaccgggacgcggatcatagtgtccgccagccattcgacatagtccatatcgcgggtaatcgacggatagcggaagtcgagatccagcacatgcgccagctcgtcaaagtaacgtttatctatccctttttcacgtaacatattgagatagctgaaaatagccgcgacgacttcatcacgattggctaaacctttatcggtcagcgttgccgaaatggcaaatacgccgctgttaccattaacaatcggatcggaatccgcgctaataccttcgaccagtccttgtttttgcagccagtcagagagcgtccctgggctacgattgccaattagataagagaccagttcatcggtcttgctgcggaactgcgcgctattgttatcaatacgaaactccacgcgcagcactttacgcggtagtgccggcacgtaatgaataatgatgcccttctgcgcctcggtgatgacaggtacggtaatttccggttttttaatctgtttattcggcacgcgaccataggttgcggcggcaatactcgccagttccggcaagggtttattactgtaaatcaccgccttcatcagattagatgaatagtatttttcatgaaaagcgatcaacgcctgttgcaccggatttcccggcttatcgcttagcgtttccagattgccgccagaaaagtgcgagcctggatgcgccgggttaatggtttcggcgcttacctgcgccatacgcataccgtcgcgggtgcgcgccatcgtcagctcggcattcaccgcgtttcgttcgcgttcggcatactttttattgagcaatggcgcggcaatggcgtcggccagtcgatctacggcacctggaagcgcgtcgttttcaacctccaggtagaaggctgttcgataaggcgcggtgctggcgttgtggctaccgccatgtcttttaaggtattcggcaaggctatccgcctgcggatatttttttgaccccatcaggcacatatgctcaagataatgagcaagcccctgatgagcctcaggatcttcaagcgatccaacgggcaccactaacgctgaaagcgactttacagcctgcggatcggatacgagcaacaccaccatgtcattatcaagacgtatcgcctgatactgccgggtatctttatcgcttttacggatagtttcttgcagcggttgccaaccgatatccgcctgaactgcaggcccccagagggcgaccaataacaataacgctttgaaccaggtgctgcggggcattcacggacctcatcattaactttcattcccactcatctgtatggtcacgtaaaccatcgacctgagcagaacgggatattattgtgctgaaccaggcagcatttttttatcagtaatcagtccgtgacgaagagcgcatcatagtcgaagccttttaatggcgcgattttcatacaatcaacgagactgattaaaacgaaacagcggtaacaggtaatgccgtgactgcgcaatgatagcctgcaacgtttcagattccagctgacgccaaagacgttgataccagatatcttcgccttcgccgctcaccatcatgttgccttcataagcctgtagaaactttgtcctggccttctgtaaagtatcatcgtcgtctaacatgacatcattttcagcgtcataacaggcttttatccatgcgccgccgctttccggcagtaccaatagcggagaagacatgccttcccggtagccttcaatcagttgcgccaggtaagccattgcctgcgttttatcaagaggcggaaatcgccactctccctctttacgcaaaaacaggcgactttcgccactaccgccgctggcacaatagacaaggtgttccagccaaagttgcacaccttgcgccacgctgattaaagcgggacgccagcgcaataatccatcctcctgtacctgcggcagccagccggttagctgaacgccattgcaaagcagatccacttccaggctttggctcggcttacggcaggcgatgacccggcttgccagttgctgcatctcctgacattgcgcatcccagaatatttcgccaaacgcgccgtaaggcaactctcccgcagcccggaaacggcggaacaagcgttcggcgtcgtcctcttcaaccagcgtattgagcaactgttggttaagttgatatcgcgtcaatccctctaattcaaacggttccgcatcaggaatctcactctcttccgagcggaaattaacctgaagccgcatctgaaaaaatgcgcgtaccggatgggcccaaaaacgctgcagactttccagagtcaatgtttccggcatcgtaaaaggaagcggctgcacaaagtcagaatgcgcttttcccgactgactcgccgcgggcaaccactctctggcataactttgctgttcgccgggttggtaattttgcgcatcaaaaggcatacgggtatgcagacgcgtaatatgcgctttgactcgtgcttcgctctcatcacaggtcagcgtttcgtcgcccggcaaatagtggctttgtccgatgtaatccaccaattcttgcaccagtacagagggaaagcgttcgctattatcctggatggagcgaccgatgtagctgatatacagcgtctgctgcgccgagattaacgcttccagaaacaggtagcggtcatcgtcgcgacggctacgatccccgcgcatgggtttttggctcatcaggtcaaagcccaacggcgcaagctggcgcgggtatacgccgtcgttcattcccagcaggcaaacgactctaaacggaatggaacgcatcggcatcagcgtacaaatattgatggggcccgccaggaagcgctggctaatacgttcctgatccagacgctgcgccagttcatcccgcagtagcgaaatcggtaccgcgtcgccatattccgccgcgacgccttcggcgataatggcctgccactgctgttcaatcaatgtcattgccgcttccgtgtccgcatcgggcaggaagaaatcattgaacatatcgcgacaaacgggcagccactcttccagcggtcgctcctgcgccagaccgcgccgccagatattaagctgcatcagcagcgaagccagatgcccgaccagctcagcaatcagaccgctggattcgtcataaggcagaaccgactgccactcgccctgggcgctttccatcgcataccccagcagcatacgcgtcaggccaaattgccacgtatgctgccccgtggcaggaagttccagctcgcgtacgttgtcatcgtcaattccccagcgaatgcctgactcattgacccacaagcgcaaataacgcagcccttcttcgttgatcgtaaagcgggcagccaataccggtacgtctaacaacgccagaacatcctcggagacgaagcggctgtccggtaacgaaagcaggctgataaatgcctgtaacaccggatgtgactgacgcgcccgccgatcggaaatggcataaggcagatagcgctccgttggcgcgctaccaaataccgcctggataaacgggctatagctgtcaatatcagccaccataacgataatgtcgcgcggcgttagcgtcggatcggcttccagcatcgccagcaggcgatcgtgcagtatttccacctcgcgctgcgggctgtgacaaacgtgaaaagagaggctgttatcctcgggatcgagcagacgcttattgtcgctgcgcgaatactcctcaagatttacgcccgccaccgcatggctttccagttcaagaatatccgcctgaatccgatgcaaaagattatctggcgtaatatcaacaaacgcatccagttcctggctgttttccagttcagatagcaggtagatataatcccgccccagttttccccatgaggccagtagcggattaccgatatcctgttcaccgtcgctgttaaataaggcttccggattctggttttcacggaacaacggtaaatgacggtcttcaaaactgtgacgacgctggcgagccatgagttttgccagccaggctgggtcttttatatccccccagtaataccgacacggattagtaaaaaggagatggatttcaatatgtttacccagcgcctgcaatgctctgagatacactggcggtaacgcggaaatgccgcaaataaaaacgcgggacggcaaccctggcgggcaggcggtcgcgctttccagcgtttgaataaagcgttggtagagattggcgcgatgccagcgcggctgccccagcgcggcggtatattccaccaatgctttccacaacggcgcctgccagttttgcgcctctcccagaccttccacggtttttcccgcttcccactgcgtaagccagtcaggccgataaaccagatactgatcgaacaggtcggcggcgcgcgcggaaagctgaaagagtttgcgtttatcggtgtcgtcggtcagataatggcgcagcagtacaaactcatccttatccagcaactgcggcagcaaggtcatcagtttccagctcatgctttgtttgctgaaagcgctttctttgggaatatccggcaacacgcggacaaacatctcccagataaaactcgccggtaacggaaaagcgatattcgccgcaataccaaacttttgtgaaagggtcatctgcagccactgcgccatacccgtgctttgtaccagaatcatttctggttcaaagggatcatccagccgctcgcgttcgacgatgaactccatcaacgcttccagcacatccagacgattggagtggtagacccttaacataattactcctgacgattaacgatttggacaatgcaagcgcgtcatctgcccctgcctgccagagggtgaaaccatcgtgacgctgatgctgacacatcccgattgcgttgtctgcatccggttggccttccagtcgtcagcaggcgaaaatggatacagcgccgtttgctgccacgcctgccgccagatctggagatactggtgtcgtaatgcaaaactgtgcattaatacccgctgatagcctgacagcgcggtgacgatcattaccattagaaccatcgccactaaaacttccgggaggctaaacccgcgttgtaaattcaggggatgcgacataacgccacctcttttaacggacaaaaatcgctccagccgtggggagaaaagacaatgcttccctgaatgacgttgcccaaacgccataacgtcatgccgtcatcttgcgccgccatcaccacctcatcccccgataatctccgcaaacagactctcgctcctgaagaggaatagcgccgacattccatttcggttacgcctgaccatagctgcccccgtccccattccagcgccgactgcacaagcgcctggcgttgtatcgccaggctctgcgtcgtcacgcgggcggcatagctggcctgctgctgatttacgccttgcagtagcagactgcccagaatcagtattaaaagcgccagtattagcgaagaagcgccacgttcccgattcacagattaaatcccgttacgctgtattgcgcgtcaataaccgtctgaggctcggctttgctggcgccgcgcagatgcagcatgagcactggcgagaatcccgttatatcccggcgctcaacggtaaacgccgtgatgagtaccgtattgggatcggtcattttttcccatcccttaccctggcaagatgttgctccgcgtaatgtctccagaacgttatccttcatacggaacccggtctggtcggcctctttcgccggtatggtatcccagaccccgttattattcccgtcccactgaacgatgacgcattgcccctgttcggcaagatgtaacccttcgccaatgcagtggccatgacagtaacccgcacgttgaagatgcttcgctacggtataggttcgctgccagatttcatcttccagcgataactgtcgcgtgttgtgccagatctcgcgttgtagcgccggtaaaaatcgtgcggacccaagcagtaaaatggaaccgatcgccatcgccagcacaacctccagtagcgagaacccccgcgtggttattgacacgtggcggcctcgttacgctcgcatagcctgattcgcccccaggaggagacgaccagacgccactctccggcagcgtttttcagtacgatgtgccctgcccatgccgtattgcgcaagccaaagaaggctaacgacggcgtgatatcggcaaggacgacatcacgccagtcgggcgtaaacacaaagggggaagatggcgtacacgatgtttgcgtagcaacagagctgacaaagcaccatgaaccgccttcgctgaccacgcgaagaatgtgatcgcggttatgccagtgagcgtccccacgaagttgcagcaggtaatcccgcacctgacatgcggtttgccacaggcgctgttgctgctgccagcgttgccagccataaagtcctgtggcgctgagaatgataatgagcgacatcgcgaccaccgtttcaatgagcgtatagccctgttgttttttcatgtcggcagtatggcgggcggaagaaaaataacgagcgccaaatacagattgttcggcgcgttacggaaaaaagttcatgtcttgcagcgcgttgcaaaatttcaggaatgcgcgccgaagattgagacgaagggtaaaaaaaaccgacgcgcgatgacgtcggttatggcaggatcgtcagcgcttagatagcgaccggcgctttaataccggggtgcggatcatagccttcaatttcgaaatcatcgaaccggtagtcaaaaagcgaatcgggtttacgcttaatgaccaatttcggcagcgcgcgcggttcacggcttaattgcaggtgcgtctgctccatatggttgctgtacaggtgcgtgtcgccgccggtccagacaaaatcgccgacgtccaggtcgcactgttgcgccatcatatgcaccagtaacgcgtagctggcaatgttgaacggcagaccgaggaacacatcgcaggagcgctgataaagctgacaggagagttttccatctgcgacataaaactggaaaaaggcgtgacacggcgccagcgccatcttatccagctcgccgacgttccacgcagaaacgataatacgacgagagtccgggtcgtttttaagctggcttaagaccgtggcgatctgatcgatatggcggccatccggtgttggccatgcacgccactgcttaccataaaccgggcctaaatcgccgttctcatcggcccattcgtcccagatggtgacattattttcgtgcaggtaagcgatgttggtatcgccctgcaaaaaccatagcagttcgtgaataattgaacgtaaatggcagcgtttcgtcgtcaccagaggaaagccttcctgcaggttaaaacgcatctgatggccaaaaatggaaagcgtgccggtgccggtacggtcgtttttctgtgtgccttcatccagcactttttgcatcagttctaaatactgtttcatggttcctcaggaaacgtgttgctgcgggcggcggcgatatgcccaaaccatcatgatcgcgccagcgataatcatcgggatagagagaatctgccccatgctgatgtactgtacccacgcgccggtaaattgcgcgtccggctggcggaagaattcaacaatgatacgaaacgcgccatagccaatcaggaataatccggagactgcgcccatcggacgcggtttgcgaataaagagattaaggatgataaacagcaccacgccttctaatgccaactcatacaactgggaagggtggcgtggcaatacgccgtaggtatcaaaaataggctgccattgcggatgtgacggcagcagcgcaatatcttccgcgcgtgagccaggaaagagcatggcaaaccggaagtcaggatcgacgcgcccccacaattcaccgttgataaagttgcccagacgcccggcgcccaggccgaacggaattaacggcgcaataaaatcagacacctgaaagaacgagcgcttcgtgcgcctggcgaagataatcatcaccagtatcacgccgataagcccgccgtggaaggacatgccgccgtcccagacgcggaataaatagagcgggttatccagaaacagagggaagttataaaacaggacatagccaatacgtccccccaggaagacccccaggaaacctgcatagagtaaattttcaacttcgtttttggtccaaccgcttcccggacggttagcgcgacgcaccgccaaccacatcgcgaaaacgaaccccaccagatacatcaagccataccagtgaagcgcgacgggcccaattgagaaaatgaccggatcaaagtccggaaaatgcagatagctactggtcatctgtcaccacaatttcttgttatttcgctgaagagatagcgattgataagcgcgcctgcgcgttgcagacgctccaaaggtgcgaataatagcacaagggttaaaagcgagatgccgattaccgttaaaagatatgtatacgcattgtctttcatcttgcaggcgtgttgtctgcgccgtgaatccacagtcactctcttttcccgctccagtcgttacaaccctcctcgaatcaatccccccatcccgcggcgctccataaacgccgccacctgatgacgcacttcggtcgccatctgcgcctcaaggctgcgtctggcaagggtttgcgcgtcttcaaaatcgatatgccgcagcagatatttcacacgcgctaccgaacggccattcatcgaaagatggcgatatcccagaccgataagaatcgccacgcacatcggatcgcccgccatctcgccgcacaagcgaagatcgaggccatgtttttcggcttcctgcgcgatcatggacagtgcgcgcagcatagccggatgcagactgtcgtaaatactggccacgcgggtattgttgcgatctaccgccaggatatattgcgttaaatcgttggtgccgaccgagataaagtcgatccggttagccagatgcggcagcataaataccattgatggtacttccagcataatgccgatacgcggtttcgggatcgcatagccgatcatctcctcgacctcgcgcccggcgcgttcgatcagacgccgcgcttcatcgacttcatcaatactggtgaccatcggcagcaaaatgctgaggttgccagtcgccgcattggcgcgcagcatcgcgcggacctggatcaaaaagatctccggctgatccagcgtaatgcggatcccgcgccagcccagacacgggttctcctcgctgatcggcatatagggcagttgcttatccgctcccacatccagggtccgcagcgtcaccggtttatcgttaaacatttgcagcatcccttgatactgcgccacctgctcttcttccgagggaaacccgctttgcagcataaagggaatttcagtacggtacaggccgataccgtcgatccgactgcctaacttttcctcatgctcgggactgagcccggcattcagcatcactttgactcgctcgccgcttttcagttgggcgggaagattgacgtcgtcctccgccagacgactgagttctatctcttcactaatgagccgctgatattcctgaataagcacgggttcaggatcgaccagtaattcaccgcgatagccatccaccaccaacgtacggcgatgtagcaccgaaggctggatatcagcgcccatgacggtcgggataccgagcgcgcgcaccataatcgccgcatgcgagtttgccgcgccgtcgcgcaccacaacgcccgccagcctgtcctgcggcagctccgccagggtggtcgccgacagctcatccgcgaccagaataaaacgttccggccaggcgtttggcccctgaactgaatcatcaagatggaataacagccgctgccccagcgtgcgtaagtctcccgcacgttctttgaggtagttatcggttagcgccgcaaattgctcggcaaatttttcgatgatttttttaacggcccactccgcaacagcgcctttgtcgacctcggcgaagagttcgcgacgcagtctggcgtctgaaagcaggtgtgagtacagatcgaaaatggccgccgtctctttttgcgcgccggcggcaaagcgtttgctgtatcgtcggaattcgttcgccgcctcttccagagcgccggtcagtcgttcgcgttcaagagaggtatccagcgtagacgcttcgtaaacctgttccatcagcggcatggtcgcgtcttgccagcccgttgcgatagccacgcccggcgccgcaggaagcgcgcggattcgcgtctgccggtattgcccgaacagcgctgtgacctgcgactgtgacaggatagccgccatctgcgtagcgagcgtgacgaggaaagactcttcgctttcatcgtactggcgcaattcgcgctgctgtacgaccagcacgccgagaagttggcgacgctgaatgatcggcacgccgagaaacgcgcgaaaacgctcctcttttaccgaaggaatgtatttaaagctgggatgtttttgcgcatcggcaaggttaatgggttccgccagtctgcccaccagaccgacgatcccctcatcaaacgcaagcgcaacggttcgaccacgcggttttttcaacccccgcgtcgccatcaggtaataacagcgtcggtcatgatcggccaggtaaaccgagcaaacctctgtatccatcgcaagacagatatccgtgaccagaatattcagcgcctcgttcagacgcggcgcactggccactttttcgactatttcgcgcaggcgagtgagcataatttgcgtggcttaacctcttttacgtcgataagcaggcgcgctttgtagcttagggggattatcctgaagcgccatgacaacacttgcaaactctttcattaccctgcggtagacatcgcgtttaaatgacaccacttgtcgaaccggataccagtaacttacccagcgccagccgtcaaactccggcgtactgctggtttgcatattgatttcggcgtcggcgctcattaactgcaaaagaaaccacttttgtttctggccgatacataccggctttgtgtcccaacgcaccaaacgttttggtaacttgtaacgcaaccagttgcgagtagaagcaaggatccgcacatctttacggcttaacccaacttcttcaaacagttcccggtacatcgcctgttctgccgactcccctggatttatcccgccctgcgggaactgccaggagtgctgaccaaatcgccgggcccacatcacctgcccctgacgattacaaattacgatacctacatttgggcggtagccatcgtcatcaatcaccggactacctcaacataaaccttatatatgaacgattgtttcatactccagtgaggcggtaaaccactctgtaatagtgacacagcctaataacaattgaataactcacagtaaatagccgagttataaacagatgatgacgcccttgcgccattttattcaccttttctgtggatatagttgtgaagaagtatggaattaccacgggaaaacccagaacagtctgaattcctcatgctggagacagtaaaaatagtgccttatattcattgcgttatagacaaatcttacatgctaccttcataaagcgtgaccagcatcacatctaagatccttatgctgatgaaagatcaaccagcgtcggttttatccacagattgtgccaataacttacgcactatttgtctgaattttcgattttcgtcgcacgtcaaggctgtaaatggaaacagtagtggcggttttacacagttatcccaactttctgtggataacatagtgtaagatcctgtttattgtcagtgaccagaattggaaaacccgcttcagcgttgcgcaacacgaagaaacaacacaaaaaaggcaataaaaatcagtctattgaatataagacacagaaaaagataaactctgcccatacggtataaaatcactgctcattttttaatctaaggtaatggtaatgtccgctctttgtccgctactgactccgcctgcttcggaagcattgctgttagcccaggcgcggcagctttccggctatacgttaggcgagctggcggcgatggccggcattaccacgcctaaagatttgaagcgagacaaaggctggatcggtgtcttgctggagatctggctcggcgccagcgccgggagcaagccggagcaggatttcgccgcgttaggcgtagaactgaaaaccatcccggtggatagtctgggtcgtcctctggaaacaacctttgtttgcgtggcgccgttaaccggtaacagcggcgtgacctgggagacaagtcacgtacggcataaattgaagcgcgtgctatgggtgccggtcgaaggcgatcgcagcataccgttagccgaacgccgcgtaggttcgccgttactctggagtccgagtgaagaagaggacaggcagctacgcctcgactgggaagagctgatggacatgatagtgctgggccaggtggaacgcattaccgcccgtcatggcgaagtcttgcaactgcgacccaaagccgccaatgccagggcgctcaccgaggctatcggcgcgcgcggggaacctattttgacgctaccgcgtggattttatctgaaaaaaaattttacgcaggcgctgctggctcgccattttttattgcagaatccgtaacgtccattacacgcaaatgcgcctccgctatggctacgcgtcggaccgacgctcgataaacgtaagcgtattgtcgccgctattttacaccgttcctggttgcgcaaattcagcctgggctttcgcccgtcactcgacgggcctataattaccgcttctttttttggcaggactttgttcgatgttatttgcatggataaccgatcctaatgcctggctggcgctcggtacgctgacgctgctggagattgtacttgggatcgacaacattatttttctttctctggtggtagcaaaacttcccacggcgcaacgaaaccacgcacggcggcttgggttggcggcggcgatggttatgcgcctggcgctgctggcgtcaatcgcctgggtcactcggctgactaatccgctgtttgagcttttcggcgaagcgatttccgcccgtgatctcattctgttactgggcgggttatttttaatctggaaagccagcaaggagatccatgagtccatcgaaggcgaagaagaagggttaaaaacccgggtttcttctttcctgggcgcaatagtgcagattatgctgctggatattattttcagccttgattcagttatcacagcggttggcctctccgatcatctgtttattatgatggcggcagtcgttattgccgtgggcgtcatgatgtttgcggcacggcccatcggcgagtttgtcgatcgtcatccgtcggtaaaaatgctggcgctctcctttctgatcctggttggctttaccctgattctggaaagtttcgacgttcacgttccgaaaggttatatctatttcgccatgttcttctctatcgcagtagagagcctgaacctgttgcgtaataaaaagaatccgctgtaatcctgtctcgctcccccgccggggagcgaatactcactttatttcctttcttctcacagattaagattttgctgcttccgacatgcagagctgcgcgttattactagactattatcagacatatgattaacagactattatcagatgcaggctatgtgaggacaaacggatgaaaaagtgggcagttgtaatttccgcagtagggttggcttttgcggtatccggatgcagcagcgattatgtaatggcgacgaaagatggtcgtatgatcctgaccgatggaaaaccacaagttgacgatgataccggtctggtcagctataccgatgcacagggaaacgagatgcaaatcaaccgtgacgaagtatcccaaatcatcgaacgttaagcggtggcctgtgatcgaggtcagcgttctgcaagccttcaggctgcgtcccgtaacggtgcgtggcgaccacgcccggtaacaattacgccgcgcagcctgcaattttactttcccttttgccttccctctgccatttttattgtcctttgtcgggaatttctgacttcataataaaaaggaaacggctatgcactatcaccgtataccccacagctcgctcgaagtaagtacgctagggctgggcacaatgacatttggtgaacaaaacagcgaagccgacgctcacgcacagctcgactatgccatcgcaaatggcattaaccttatcgacgccgccgagatgtatccggtaccgccgcgcccggaaacacaagggctgacggagtcctatatcggtaactggctcgccaaacgcggcaaccgtgaaaaactgatcatcgccagcaaagttagcggaccggcacgtaataatgatcaaggcatccggcctcatcaggcgctggatcgtaaaaatattcgcgaagcgctacacgacagtttgacccgattgcagaccgactatctggatttgtatcaggtgcactggccgcagcgccccactaactgcttcggtaaactcggctataactggacggactccacgccagtagtaagtctgctggagacgttagacgcgctaagtgagtttcagcgagcgggtaagattcgttatattggcgtttcaaatgagacagcgtttggcgttatgcgctatctgcatctggcggaaaaacatgacctgccgcgtattgtcacgatccagaacccctatagcctgttaaaccgcagctacgaggtcgggctggcggaagtcagccagtatgaaggtgttgaattgctcgcctactcctgtctggcgtttggcacattaaccggtaaatacctgaacggggccaaacccgcaggcgcgcggaataccttgttcagccgcttcacacgttacagcggcgaacaggcgcaaaaagccgttgcctcctacgtcgatatcgcgaagcgtcacaatcttgatccggcgcagatggcgctggcctttgttcgccgccagccgtttgtcgccagtacgttactgggcgcaaccacgatggcgcagctcaagacgaatgtggaaagtctgcatctgacgttaagcgaagaggttctggcggagattgaggcggcgcatcaggtttatacctatccggcgccgtgatggtcagtgcccggtggcgctacgcttccgggcttacagagacaatgtaagcccgataacacgcactcgccgcccggcatattcactcagtatgatgcctgccggcgctgccagatccacagcgccgcgatcgccagcgcgaacagcacgccaaagccgatacctatcgccactgccggaacgccaaccagcaccgccagcgagtacagtcccagcattaatagcatggcgctattctcgcccagattttgtacggcaatggcattcccggcgccaacgctcttcttaccgcgctcctggagcaaagcgttgagcggcaccacaaaaaagccgcccagcatacctatcaacagcaacaaggcataagcaggcagcaatgcgtgctgtaatgagaagatcgcaaccacaacgccaatcaaaatcccggcgggcatacagcgcgatacggtctccagcgtcaccagttttgccgccgcgcccgcgccgaccacaatgcctaccgccaccatggcgttcaggtaagtcggcgtggcgttatccgtaatccccagcgccaccggcacccacagcaccagcagaaaacgcagcgtcacgcctgcgccccagaatagcccggtccccaccagcgaaaaacgcgtttcaccgttacgccaaaggacaacgcaagcgctgaagaaactacgcgtcatcgccgacaaccgccaggattgtcctggacgcgccgccacaagcttcgggataaacaggttcgccgccactgcgccagcgtaggccaacgcgcaggcaaccagcgcagcgatgacatgccagtcggccaatacgccgcccgcgacggaaccgagcaaaatcgccgcaatcgtagaggcttccatcaggccattggctttcaccagcttatcgcccgtcgtcagttcgcccagaataccgtatttcgccggagaataagccgccgcgccaatcccgaccaacgtataaccgacaaaaggatttatgccgaggcagatacctgccgctcccgccagtttaagaccattggcgaccatcatcacccggcctttggcaaagctgtccgctatctggccgacaaacggcgcaaaaagaatgtaagcgcccacaaacaccatttgcaaaacaggctggctccagtccgggtaaaactgagctttcagcagtgccagcgtcgcgaacagcagcgcattatcgccaaaagccgagagaaactgcgcgacaatcaccgacagcatccctttcgaccagatggaggtgttagtacgtactgactcactcatgatgttgttccggcgcatccacccaacttttcagcgtcacaaaatcgggtttcccgctgccaagcaagggaagctgcttcagataacggatatcacgcgggacggcaagttccggaataccgtgttcacgagcatagtgctgtaacttttctcgggtgagttcgctgtcagtcgtaaacagtaccagcgcttcacctttgctggcatcgcttttaatggcggtagcgtgcattttgtccgccgaaacgccaagcgccagttgctcgaccatctccagcgagaccatttcgccagcaattttcgcaaagcgtttcgcgcgcccctgaatctgcacaaaaccattttcatcgaagcgtacaatatcgcccgtgtcgtaccagccgcgctcagtttcgcctctggagttttccgccgacggcacctccagcacgcccggtttttccacgcgcagatagccattcatgatattcggccctttcagctgtagccgaccgccgttttcaataccgggcaccgccagcagacgcgcgtccatgccaggcagaatgcggccaacagtgccaggcttagccgccatcggcacgttaatcgagactactggcgcgcattccgttaccccgtagccctcaagaatgcgcagaccgaatttatcctgccacagttgtttggtgctctcctgaagtttttccgcaccggccaccacatagcgcaggcgataaaaatcatacggattggcaaagcgcgcatagttgccgaggaaggttgacgtaccaaacagcacggtacagttacggtcatagaccagttccggcacaatgcgatagtgcagcggacttggataaagaaatacttccgcgccggtcaacaacggcgtaaacaggcccaccgtcaaaccgaacgagtgaaagagcggcagcgccgacataaaacggtcattggcggtgaaatccgcaatcgtttttatctgctcgacgttcgccagaatgcttttatggctgtgcaccacccctttcgggtgcccttccgagccggaggtaaaaagaatgatcgccgcgtcttccggctgctgttttacctgcgccagtcgcggcgccaggaggtgggcaaaaatccacagcttgtcggcgggtgtgacgtccgcttttaaatcttccaggtaaacccagcgaacctgcgttagctgttccggcaggtgccacaatttacctttatcgaggaactggcgggaggtaaaaatcgttttaatttccgccgcggtaatcgcgctggtcagcccttttacccccgccgtgtagttcatcatggccggaatgcggcgacgagaaaccgcgccgaaaatcaccgccgcgctgatggcggcattcggcagcattaaaccgattttctcgccctcaacgctgtacttttccagaatccggccaacaaaaagcgtcttggtcagtaacttacgatacgtatccggcgtaaagttaatgtcctcaatacagtttttacccgcgccgtaacgatattgcgccgccagcaacgattcgtataacgtctcgcgcgggcgcaccgccatacgcgcttccatcatgatctggtgcagcatctcacccgctatcttacgtctgtcgcgcgcgcgcggcgcttccggcatcggtatttgcgtcggcggtaaaatatgaagctgaatgcgggggaataagcgccgtttaaccagacctttcaggcgactgaaaggggtcagctccgcgccgtcaatgcggagcggaatgacggttgcgcccgattttgccgccacaaagcctgcgccgtcataaattttcatcagcgagccggtcacggaaatccgcccttccgggaaaatcaccactggacgcccctgttccaccagacgcaccaggtgtttaatggacatgggtttagtggggtcgagcggcacaaaatcgatcagcggcgttaaccagcgcatataccattgctggctgatggaggtatataccgcaaagacaggccgtaccggcaaaaacagcgccagtagcataccatcgataaatgaaacgtgattgggggtaattaagacccggttcccctgtagcgcccggacatcgccagtgacgcgcacacgataaagcacgcgaaacaggttacggaaaaatccaaacagcatttcaactccctttggccgacaattcgctaaaagatgaattgtggcagattacacgagttgcgtaacaggagcgatagcaaaataggttcgaaaaaaaacctgcgcatccgcgcaggttggtgcaagagacaggtacgaagagcgtaccgaataatctcaccaatcaatacctctgggatcttgattgtgggcttcgcgcgtctgcatcgccagtccgaaaacgcaaaggaataaacggaaatgcaacgagttgtgtaaattatccgttactgttacaggttcaggcgaaacaaaaaaaaacctgcgcatctctacgcaggttggtgtaattcgtgtgatcaacaatgacgttgattccacctatcaatacctctgggatcaccactctatcaacctgactcgctggcctgccagcagacaatcgcaacagcgcttcgcaaactgtaacgaaagatttgtattgtcactttacagacgcatttctcccgtgcaggtcacatttgcccgacacggcggggcaagaggcttgaacagacgttcattttccgtaaaactggcgtaatgtaagcgtttacccactataggtattatcatggcgaccataaaagatgtagcccgactggccggtgtttcagtcgccaccgtttctcgcgttattaacgattcgccaaaagccagcgaagcgtcccggctggcggtaaccagcgcaatggagtccctgagctatcaccctaacgccaacgcgcgcgcgctggcacagcaggcaacggaaaccctcggtctggtggtcggcgacgtttccgatccttttttcggcgcgatggtgaaagccgttgaacaggtggcgtatcacaccggcaattttttactgattggcaacgggtatcataacgaacaaaaagagcgtcaggctattgaacagttgattcgtcatcgttgcgcagcgttagtggtgcacgccaaaatgattccggatgcggacctggcctcattaatgaagcaaatccccggcatggtgctgattaaccgcattttaccggggttagaacaccgctgtgtcgcgctggatgaccgttacggggcatggctggcgacccggcatctgatccagcaaggtcatacgcgtattgggtatatctgttccaatcacactatctctgatgccgaagatcgcctgaggggctattacgatgcgctggcggaaagccatatcccggctaacgatcggctggtgacgttcggcgaaccggatgaaagcggcggcgagcaggcgatgactgagttattaggtcgcggcagaaattttaccgcggtggcctgctataacgactcgatggcggctggcgcgatgggtgtattaaatgataatggcgtgggggtgccgggcgaagtatcgctcatcggttttgatgatgtactggtctcacgctatgtgcgtccccgactgaccaccattcggtatccgatcgtcaccatggcgacacaggcggcggagctggccttagcgctggcagggaaatgtcctacgccagaagtaactcatgtatttagtccgacactggtacgccgacattcggtgtccacgccgacggataccgggcacctgtcgacaaccgattaatcagggtagcatgatggcgacaatgctggatgtttcccgccatgcgggcgtatcaaaggccaccgtctcacgagtgctgaatgggacggggcaggtaaaagaaagcacgcgccagaaagtgtttacggcgatgcaggctctgggctatcgccccaacctgctggcacgctcgctggcgaatcgcaccagcaacagcatcggtctggtcgtctctacgtttgacggcttctatttcggcagtttgttgcgccgggcgtcgcgccaggcggagtctcataacaagcagttgatcgtcaccgatggtcacgatacgccggaacgagagcagaaagccgtacaaatgttggccgacagacagtgcgacgctattattctttacactcgctatatggatgagctggcgattttgtcgttgattgacgccacggaaatgccgctggtgattattaatcgcaacgtcactcaggcccgcgatcgcgctattttcttcgagcaggagacggcggcattccaggcggtggaatatctgattacgcagggccatcgcgatatcgcctgtattacgctgcctgttcatactcccaccggcacatcacgcgtagcgggttatcgcaaggcgctggaaaagtatggcattccctggcaaccggcaaaagtgaaatacggcgattacacgctgacgcgcggctatgacgcctgccgggaattactggaggaaggcgtcacgtttagcgcgctattcgcctgtaatgatgacacggcgctgggcgcggcaaaagcgctgcgccaggccggattacgcatcccacaggatgtgtcgctgtttggttttgacgatgcgccgggcgcaacctggcttgagccggggctttcaacagtctatttacccatcgaggctatgatagccaccgcgatcgatcaggccgttcgtctggcgaacagcgagccggtcgccccgatcccgccctttaccggcacgctgattctgcgcgagtccgtcgccgcgggcccgttttttcaacgtccggcctaatgatgcgcttcagagcatctccagcgctaacagctcttcaatggtttgacgacggcggatcagccgcgcctgtccattgtcaaacagcacttccggcaggagcgggcggctgttgtaattcgatgacatagacgcgccgtacgcgccggtatcgtgcaatacgaggtaatcgccggggatgaccgcaggtaaggcgcgtgtttcaaccattcccccttcctgctgcgtaaaaacatcgcctgattcgcatagcggcccggctaccaccgtctcgacccacgggccattttcaagcgcgcgaccatccgccgccagcgccgaaatacggtgatagctaccgtacatcgccgggcgcatcagatcgttaaaaccagcgtcgaccagcacgaaatggcggcttcccatctgttttacgctacgcacctgcgttaccagcacgcccgattgcgccaccagaaaacgtccaggttcgatctcaagtttgaccgcatgtcccagatggcgggcgatttgctcgcgcgccgcgttccacaggccatagtaatggcgcgtatcaacgggctcttctccctcacgataaggtatcgagagtccgccgcctgccgaaatcgcctccacatcctgaccacattccagcacctggcgtaccatcgcgccgcaaacctgctccagatggccataatcgacgccggaaccaatgtgcatatggataccgacaagtttcagtcggtatttctgcattaccgccagcgccgccggaagatcgctatgccagatgccgtgtttgctgttttcgcccccggtgttggttttctggctgtggccgtgaccaaagccaggattcacgcgcaaccagacgcgatgcccaggcgaaacctgaccaagctgcgtcagcatatctaccgagccggcattgaccggaatatgcagttcgctgacgcgcgccagcgtggcggcgtcaatcacatcggcggtaaaaacgatatcatcagggcacgtttgcggatcgtagcccgccgccagcgcacgttcgatctctcccaatgaaacagaatccaccttgacgcccagcgcgcgcattaagcgcaggatatgaatgttcgaacaggctttttgcgcaaaacgcacgacgtcaaactgctgcagggcggctatctgacggcgaataatgtgcgcgtcatagacccagaccggacagccgaattcagcaggcaatctgagcaaattttcagcgttaaggtcagtttcagcgtgataatgcggcaatgacataacaaactccggaacgggctttttaacgattacgccataccttagaaagaataaaaaatatcgttttattgtcagtctatgcaaaaatgatatgggataaatgattcagggaaacgtatggctgccgttaatttacgtcacattgaaatttttcatgccgtaatgaccgccggaaatctcaccgaagcggcgcggctgctgcatacctcgcagcctaccgtcagtcgcgagctggcgcgttttgagaaagtgctgggattaacgctgtttgagcgcacacgcgggcgcttacatccgacggtgcaagggctacgcctgttcgaagaggtacaacgctcctggtatgggttggatcgcatcgtcagcgcggcggaaagtctgcgcgagttccgtcagggcgaactctctatcgcctgcctgccggtcttttcacaatcctttttgccgccgttactaccgccttttctggcacgttatccggatgtcagcctgaatattgtgccgcaggagtcgccgttgctggaagagtggctctccgcccagcgccacgacttagggctgacggagacgcttcatgccccggcaggaacaacccgtaccgagttactaacgctgaatgaagtgtgcgtactgccctgcgaccatccgcttgccgccaaaacggtactgacgccagacgattttcagggggaaaactttatcagcctctcccgcctggacagctatcgacagttgttggatacgttatttgccgaacatcaggtgaagcgcagaatggtggtggaaacgcatagcgcggcctccgtctgcgcgatggtgcgcgccggggcgggcgtttcgatcgttaacccgctgaccgcgctggactatgccgccagcggcgtcaccgtccgccgcttcagcattgacgtgccctttaccgtcagcctgattcgcccgctacaccgccctgcctccgcgctggttgacgccttcagtaagcatttacaaacgcacctttcgcgcctggtcgaaccgctggaggttattctggggccgatgacgaaagcataaagctcacggcatctgcggcatgaattgccgtggtatcgaaaaccggtagcgcgctttgcgtctggggaacaagcaaacctatttcagtacagccaaaaataacgccctgcgcgccttgcgcagccagttgttcgataacctgtaaataatagtggcgcgacgcgtcagtgaatgtcccctgacagagctcgtcaaaaatcacctgattgatacgcgcccgatcgtccgcctccggcacgatggtctcaatcgcaaattgctgttccagccgcccgcgataaaaatcctgttccatcgtatagcgagtccctaatagcgccacgcgatgcaacccctgacgggcgatagctcgcccggtagcatccgcgatgtgtaggaaaggcagagaacaacgagattcaataacgtgcgcgattttatgcatggtgttggtacacagcacaatgccttctgcgcccgcctgctgtaacccatgggcggcctgcgccaggatatcgcccgctttatcccactcgtcgcggcgttgacatacttcaatatcgtggaaatctacgctatgcagcagtaagctcgccgagtgcaggcctcccaactgctgtttaataccttcattgattaaacggtaataagggatagtcgattcccagctcatcccccccaacagtccgatcgttttcactgcgctctcctttttgtaaagcattatggcagtgaagcaaacttacacatccgtttccagtctatttttcatcatgccggataacaggcgtcatccggcatgggaggggggattacacgccaatatttcttagcttctcgcccgccatcagcttgcgttcgatgtgctccagggtgacatttttggtttccggaatcagccagaaagtgatgccgataaaagcgatattcagcgcggtgtagagccagaatgtacctgccgcgccaatgctgtccaacagtgtcaggaatgtcgcgccgatgatcatgttcgatacccagtttgtcgtggttgaacaggtaatgccaaaatcacggcatttcagcggctggatttccgaacacagtatccacaccaccggagcggcgctcatcgcgtaaccggcgatacacatcatcgtcatcccaacggaaagccaggagagaccgcttgatgccgtaccgttatcaaactgcatcaggcagtagcccaacaccaatgtccctaacgccattacgctgaaaccgatttttaacgccggtttacgcccggccttatcgaccgtaaagacggcgataaacgtcgcgaacataaaagtcagtccgaccaccagcgtggcgatcatttgctgttccgtggtggtaaagccggccattttaaaaatgcgcggcgcatagtacataatgatgttcatgccggtgaactgctgcattgcctgtagcagcataccgaggaacacggcgcggcgaacattgcggttagctttaaataatgcccaccctccctgcttgagtttgaggctttcccgaatctcattcagttcatcacgggctttttccgaggtatcgcgcagcatacgcagcacctcttccgcttcaatatggcgacctttttgcgccagccaacgcggactattcggcaggaataccaccagaataatgagcaacaccgcaggcagcgccagcacgcccaacatcgcgcgccagttgccgctgtagctgaatgccgtatcggataaaaaagccagcacaatgcctaacgtcaccatcagttgatacatactgatcattttgccgcgaacattttcacttgccatttcagagagataaagcggcgcggtataggaggcaatccctactgctacgcccagtatcacgcgggcgccaatcaatacttccacgctggaagcaaacgccgaccccagcgagccgagcacgaacaaaatcgcgccagccatcaggctatacttacgccccagccggaatgaaagccagccgttaaataatgcgccaattgccgcgccaagcatcatgctgctgacgacccattcctgcagccggctggtcagtacgaaatggtcggtaataaaaggcagcgccccggcgataacgccgatatccagaccaaataacagtcccgctaccgctgcagaaaccgaaacaaacatattcatacgtcgtgtgtcgcgaagcgaacgcggcgttaaagcagagtcatgattaatagagaccatattttcctgccacaacagagtaagacatagcctgaaagtacgggatactcttcctcaagtgtcaggctggaaacggcataaatatggattaaatggctacgctatagcgatatgtgatggatattacactttttaaatttaacgccgttgccgggtatttttttaaaccaccaatatttcaatgaattaaagcattgatcatagctattatttaacaatatatggattaagttaaacccacaatatggactatgctaatgagatcataaaaaaaccctgtacgaggacagggctttatcagttttttcggccaaagcgtcgattttcccagaaacgcatttgtcagtagcggattaacgcgccagccaaccgccatctaccgctatggtatagccgttaatataatcagcggcgctggatgccaggaagactaccggccccattaaatcgcccggtagcccccaacgtccagccggaatacggtcgagaatttcggcgctacgttgtgcatcagcgcgcaattgctgggtattattcgtggacatatagcccggtgcgatggcgttcacattgatattgtgtttcgcccactcgttcgccatcagacgtgttattcccattacgccgcttttcgacgcggtataagacggaacgcgaatgccgccctggaaggagagcatagacgcgatattaataattttgccgccgttgccctgggcaataaaatgttttgccgccgcctgagacataaagaacacgctcttgatgttcaggttcataacgtcatcccagtctttttccgtgaaatcaatcgcatcttcacgacggatcaaacccgcgttattcaccagaatatcaatatgaccgtattccgccaccgcccgttccagtaatgccggaatgccatcgatttgacgcagatcggctgtcaggcttaaaaaacgacgtcccagagcggtgacgcgcgcaatagtttccgtcggttcaacaatgttaataccaacaatgtcacagcccgcttccgccagccctaacgccatcccctgccccaatccggtatcgcaccccgtcacaaccgcgactttaccttcaagagaaaatgcattcaaaatcattgttaatccttatttttgtcatgcctgtcacgcacaggcgttatcaccggtcgcgactagcgcagatcttgtaccgcaacgtgatccatgtcatcgaagacctgattttctcccaccatgccccaaacaaacgtataggctttggtgccaacgccggaatgtattgaccagcttggggaaataaccgcctgttcattacgcatcacaatatgacgggtttcctgaggctgccccatcatatggaaaacgcaactgtcctcttccatattgaaatagaggtacacttccatacggcgctcatgggtatggcatggcatggtgttccatagattgccgggcgccagttcggtgagtcccatactgagctgacaggtttccagtacatccggtacgaaatatttattgatagtgcgacggttactggtgaggttatcgcctaaggtgacgggcgcaacgtcggcaggcgacacttttttcgtcggataagcggtatgcgctggcgcgcagttgtaataaaacttcgccggtctgctcgcctcattgctgacgaagaccagctctttcgcccctttaccaatatacagagcatcacgatgaccaatgtcatggcgctgcccgtcaacgataatggcgcccgcgccgccaatattaatgacgcccagctcgcggcggtccagtaatcgggaaacgccaagctgtttacctacttctccgccgatttcaacgggatggctgacgggcataatgccgccgacaataatacggtcgatatggctgtagaccatcgtatattcatcagcgacaaaaatattttctattaaaaactcgcgtcgcagcgcctgggtgtccagcgttttagcgtgctcgctatggatactttgccttacgtccacttttccctccaatgataaatcgatcgcaatggcacaaaatcaaaacactgttttgatttatttaacggcatcatagtcgcctggataaaggttttcaacaataaataaaacaacgtttcatttatatggttggttatttttaaaactgctgtagcgatcacgatcggcgctaaaacttacgcatttgtctgattttcagacatgcgcgccagatgctgtatgcggttacccagataaaaattggagcttgttttagaacgaggtctgatgtgcgaattgaattaaaagcggtatgcgtctgcaatgcccgacgcggcaagacgttccgcgctataacgaaaaagggggttctgtcactggctttgccctcgtgatagagggctttttatgacggaatactgaaacaggaaaaggatggctggcgcaggatcagtcgcgttcaatggttaaagcaacgccctgaccgccaccgatacacagcgtcgccaggcctttacgcgcgtcgcgtttaaccatttcgtgcaccagtgaaaccagaattcgacagccggaagcgccaatgggatgccccagcgcaatcgcgccgccattaacgtttacccgtcgctcatcccattccagcatttttcctaccgataacgcctgggcggcaaacgcttcgttggcttcgataaggtcgacctccgtcagttgccagccggcacgctccagacagcgccgggtagcatataccggcgcaatccccattagcgcaggatcgacgccgacgctggcaaacgcgcggatgcgcgccagcaccggcagccccagcgcctgggctttcgcctcgctcatcatcatcaccgcggcggcgccatcgttgattgaggaggcattacccgccgtcaccgaacctaaactatcaaacgccggatgcagcagggctaacccctccgcactggcgtcggcccgcggttgttcatccgtatcgacaattgcggtctgcccattacgttgcgtgacgatggggacaatctcatctttaaaacgtccggtatcaatcgcggccctggctttttgctgcgaactgagcgcataagcatcctgtaactcgcggctgatgccatattcccgcgccaggttttctgccgtcacgccaatgtgataatcgttgaaggcatcccataagccatcatgtaccagactatccaccagattgtcggcatcaggcaacgcgccgctacggctgtcattgaggacatgcggcgcacggctcatattctcctgcccgcccgcaataacaatgtccgcttcgccgcactgaatagcctgcgtcgccaggtgcaacgcttttaaaccggaaccacaaacgtcattaatggtaatagcggaaacggtagtcggcagccctcctttgatggctgactggcgcgccggattctgcccggcgccagccgtcagtacctgaccgaggatgacctcatcgatagcgttagcgtccacgccggtgcgctcaattaacgcttttacgaccatgctccccagctcgacggcggaatgacgggccagcgttccctgaaaacagccgatgggtgtccgtaaagcccccactatcacaacctctttcattaccacctcagcgcaaaatgacaccgccatagtagagcattgttaaaattagttttcttgattgtttaaaaaaagtgagttttatcacaaaggaaatgacgctgatttgacggtgacgcagcttatttctgctgcaaatggtagcgaagccagttccccgccgttccgggcggcgttttcttgttccacagcaaatcaatagcaatcgccctcggccagccaggaacatccagctgcgccagcggtttttccgccgcaaactcttccaccagcgcgcagggcaatacgcaccagccaaatccctgaaccgccatgctcaacagtaataaatagtttggcgctgaccaggccgggccgcgcgtaatgttggcgttagagtcaagataggtattcagacgcagctcgcgccaggtatgcagttgctcccattgcaggttcgtctgtgacgccaacggatgcgtggtcgccacataaacccccatccagctttgaacaggcagacgcgccgcgccaatgtctgtgggatagtcatcacgcgcttcaatcaggcctatctgggcacgccctttttgcagcaggtcgatgacatcatcattttctccgatcaagcattcaaactcggtatgcggaaattgacgatcaaactgcgccattaactcttccagactgtcagggtgcagggtatcagagaggacgaacgtgagtcttgcctccgtctcgccggataacgtcagcgccacctcatccagacggtcgctcgccgataaaatagcctgaacatagctaagcacccgttttccttcttcggtcagaacgggctggcgcgaagatcgatcaaataatgaaaatcccagatccgcctccagatgcgcaatggcgatactaatggtggactggcttttacgcaggcggcgcgccgccgcagaaaacgaaccgcaagagacggtctcaacaaatgctattaaagcttcaggtgagtaacgcataacctatctactttatcgatggatgttatcttttaggtatcacattaaacgataaaatagcggaaatttctttagcttgattaagagtaaggttttttcgtttatgcaacatgacgccatacaacgtcgctcgctgccggagcgtattttccatgctgtctgttttgaaggtattgcgactgcgatactggcgccaacgaccgcctggctaatgcagcgctcggtgctggagatgggcggcctgacgatattgctggcaacgacggccatgatctggaatatcatttataacgctctgtttgatcgactgtggcccgcgcatcaggtgagacgaaccgccaaagtgcgcgcactccatgcgttaggatttgaaagtgggtttattgtcattggcgtcagtattgtcgcttgggtactgaatgtcagcctgctacaagcattcaccctggaaattggtttcttcctgttctttttgccgtacacgatgctgtacaactgggcatacgatgttttacgccaacgaatagtgactcgccgccaacagcgcgttagtgcatgatattgctcttttttgccgggatcgcaacgctcccggccctccgcctccacgacatccatctgcttaaaacgcccccaactgacgctatttatggtaaattgcgcttctttttgtgtgttttatagttgataaattcaaataatgtctaaaatttggtcaaaagatgagactctctggagttttgcattatacggaacggctgtaggcgcaggcactcttttccttcccatccagttgggatcggcaggcgcaatcgtgctatttattaccgcgctggtcgcctggcctctaacatactggccgcataaggcgctgtgtcagtttattctttcctcaaagacttctgccggtgagggaattactggcgccgttactcattattacggcaagaaaatcggcaatattattaccacgctttatttcattgcgttttttgtcgtggtattaatttatgctgtggcgattaccaattccctgacagagcaattagcgaagcatattcagatagatattcgcatccggatggcagttagcttcggcgtagtacttatcctgaatatgattttcttaatgggaagacatgccactcttcgcgtaatgggctttttagtctttccacttatcgcttacttcttgttcctttcgctctacttaaccggaagctggcaaccctcgttactgaccgggcagatgtctttggatagtcacacgttgcaccaggtatggatttctattccggtgatggtttttgcttttagccatacgcccattatttcgacgtttgccatcgacagacgggaaaattttggcgatcaggccatggataaatgcaaaaagatcatgaaggtcgcctatctgattatctgcctgagcgtgctgttctttgtctttagctgcctgctctccattccgccgtcatacattgaagacgcgcgcaacgaaggcgttaccatcctttccgcgctctcgatgatgcccaatgcgccggcctggctctctatttccggtattatcgttgccgtcgtggccatgtcgaaatctttcctcggcacctatttcggcgtcatcgagggcgcaaccgaaatggtaagaaccaccctacagcaggttggcgtaaaaaaaagccgggcgttcaatcgcgcgctgtctatcatgctggtttccgggattacgtttattatttgctgtattaacccgaatgccatctctatgatttatgctattagcggcccgctcattgcgatgattctgtttattatgcccacgttgtcaacgtacctgataccggcattgaaaccctaccgttcagtaggtaatttcattacgttggtcgtcggtttactttgcgtatcggtgatgtttttcggctaaagtaaaagatagccgggatataactcccggctattttatataagaatccagcacctttaatattacgtccagatcttcttcacgtctggcttcatcactctgatgaacgatatgctcggtcagatgacctttaatcacctcgcgcattaagccatttaccgcgccgcgaatcgccgcgatctgttgtaacacggccgcgcattcatgcggttcatccagcattttttttagcgctatcacctgtccctgaatcttgctggttctggctttaagcttttgtttgtcccggatggtatgtgacattacaacacctcactaacattaacgaatacaaattatagcattacgatgctactggggggtagtattctatactgggggggagtagaatgacgcccacataaaacaactaagaatcattctcatgggtgaattttcgacacttcttcagcaaggaaacggctggttcttcattcccagcgccattttattaggtattttgcacgggcttgaaccagggcactccaaaactatgatggcggcttttatcattgccattaaaggtacggttaaacaggccgtcatgctcggtctggcagcaacgctttctcataccgcgatcgtctggttaatcgcgctgggtgggatgtatcttagccgggcattcaccgcacaatcagtggaaccatggctgcagttaatttctgcgattattattctgagcaccgcgtgctggatgttctggcggacatggcgaggcgagcagcagtggctggcgggaaaccaccatcacgaccacgaccacgaccacgaccacgaccacgaccacgaccacgaccacgaccacgaccacgaccacgaccacgaccatcatggtcacatacatccggaaggtgcaacgtcaaaagcgtatcaggatgcccatgaacgcgcccatgctgccgatattcaacgccgttttgatggtcaaacagtgactaatggacagatcctgctattcggcctgaccggagggcttatcccctgtccggctgcgatcaccgttttactgatttgtatccagcttaaagcgtttacgctgggcgccacgatggtgctgagctttagtcttggcctggcattaacactggtgacggtaggcgtgggcgcggcgataagcgttcaacaggcagcaaagcgctggagtggtttttcgacgcttgcccggcgggcgccctatttttcgagcattctgattggtctggtcggcgtgtatatgggaattcatggctataccgggatcatgcagtaaatatgtaacgcttctgctcaggccgtatcattcacgtcgggtttcattccagaagcgtttttacttatcaaacggtatgaaaggccatacattcagcgtcccgcctgaattctgtattttactccactacaccacaggcaaaaaataccccaccgccaccgggtttagccggcgtgtcagtgtttctggatagggtcgccggaggcgggttattgcggagcgataaacggggttcgctgcagtgatttacaaaaccgggtaccaaacagcagttcccgtaatcggttccgcattcccagcttcaccagtaaccggtatttgtcctgccagatttgcttctcctgtgtattcagccttccacacaacgctgacaaccttcctcgtccacggtaaacttcctgaagcaagcgtaactgggccaggctcactccgcatgccagtatctcccggtgcatcaactgatccatatagttcatcaaccgcttcggattgttaaatatcggtggcacttccagaaagcccgtcaccggatccggagataacaaaaaggcgtccagcgctcctgtcctgcgcaggcgtgcgcccccggcccactgttcatcccgccgccaccgaataagtatctccgccagttcctgctccagcagcgccgggatgccgccgtataccttcagtaccacccggtcgctgaaaaacagctcatcgctgataatcataaccgggtagtccggcagtatctgtctcagggaatagaacaaaaagagatgttcacggggacgcagacacagtatcagtatggcctccggtttccgacgtaattgctgcaacagaacaggctgcctgtatgcggtttcacagttgcagcccggcataaatctccggaccaggtgtgccacggcgatcgtcaccggccagcagtcaccgtaaacgataatctgccaggccggtatccggttatgttccgtcatcctcatcctccttctttttcaggatcttccccgcatttctgttactgcacagccggttccacagttcatttgccatcgacctgtcaccattaccgacccggcgttttgataccagcggcggtccggctttttcacggcgcgtggacggggtgggactgtcaagaacccggataacataaatctcatagcgtcgtgctttattaggcagggtctggtgacggcagatgctgaccacccgcgatgttttgcttcgcagataggcaatcaggtagctggcccgtctggccgtgatgtgaaacgcctctgctatctggttacgctgaacccagttctgctgcaacaggcaccagtgtgccacaatgatatacaggggctcgccggcatactggcggacacttaccggaataaaacaggcatcatggttggtctgtccgggataatgaatatcgttaccaggggtaaggtactgcttttttgcgtgtgtattatcagggcacataaaacctctccataactgggtaaatgatttcccggaggtgaagaacaactcttaaatagtatttattattaatgtgtgtttattcgggattagttccccgataactcagtcagttcttttatttttattatctgcccccccgattagttataggtaacagtaacgggtattgcagcagaaaacgttcctgtctttacacttccccccggggtcggggttattactgcagtatataccttcgacacattaccggtgacagctcctgtaatagtaatatcccccagtacttcttgtttatcaaaagtaatctcttttcctttatcatcttttattgaaagccggagcccattaggctgacctttgttggggccatccaggctgacaagattcagagtttgcccggtatcctgtgtcagtgcacctttcccgaaggtgatggccagagggatcgtgaattcctgtcccatagccggtcgtaaaacctgcctggcgatcactgtaaaatttgcctgtctggtctgtgaaggttcataagtcgtataaatatgcccaaagttgacctgtaatggaacaatgtcaactttacccaatccgtttctgagaattctcacattaaaaccagataaaacaaatccgttttgtctcaaagaataagaaaaaggtacaatatttaaaacattacttatccccgtaaaagctgtaactgcactactctctgaatatgcttttgtatataagaaatccagtgttatccttacttttcgttctgtagtcccaacaggtagttttgtgccaaactcttttcgtaactcatttcctgactgagtactctttatttcatcccaggagaacgaaacaacacttgaagcatttcctgtttcttgaatggacattctgaatccaagtcccatcgcatctagtgtcttggtaaatttactgaagtagccctgattaaataccagctgtggaaattgcgtgtcatatcccatgtaacatttaaaaactgcatcctgattgattgtatagataaccgaatccgggccaggtttaaaatcatcggttgtcaaatttatacttcttaaattaatattctgaccggaagtgactgcacattcatttatacctagctcaaccgcatacactttagtcacacataaagagcacaacatcatcaccagcacggtcagttttgttttcagattaaaaatccattctgtcatgatgtcgcccctgcgtccttaaacgcgcagttcagggcatcgcaggtgtagcgattcatctgcagtcccccgtaatcatcaatataccccacccacagcgtccgggtttctgccggcagaacagcctttaaaggcaggttccccaggggcggcaccatcacgccctcgcggaaaccgctgagcctgtggctacggtctgctcccagccacgccacagtgatgtagtacggcgtcgggtttctgagggtcagatgtcccgcattccgctcagcagtcagctttctttccggctggtcactgctgcttctgataatggctttcggacggtaaaacagtttcagctggctctgcatggccagctgcaggacgttgtcgtcttccggcttcgggggaacgccccgcacgttaaaccagaacagtgtttccctgtcctgagggagcttatctgtcagcccgcgaacctgggtgatacggacctgggatttctgtccggcatcaatacgctgcagcggcggcagcgccatcagcgcatcggttctcaccccgtcagcatccgtcacccaggactgcgccaggaacggcgtggttttgtcatcgttattcagcgtgatggccaccgttttctgcggcgcatccatgataatacgggtccggtcaacattgacggccgccgggctgtactggctccatgccgccgccagtgcgagtaaaatcacacggcttcttctgctgtttttcacctgttttctcctttagacctgctctgtgacagggatatttttatctgcagggcagtaacagcggcccccggctgagtgtcaccgtttccggcagggtgagtctgcactgcacccggccatcccaggacacattcagggtccggcggtcttccccgctgagacctgtcaggtaggccagaccgccatctccgaccatccccgcggttctgccggttttccaggacaccaccagggcgccaaacggcggacttgcgccatcagccagccggatatgaccgagcacctgctccccctggttggcgtcaatcttccggtagcccaccgcgccctccgtcagcacctggctgatgacggagctgctgacgtccacgtcctccggcagggcggccacatcaaccgaaatatcgctgcggcgatagctgctgccggcgctcaccacgcccaccccgaagcggttggtcaccccgctgttgccgttcaccggcacaccggccacgtctccggtatctatcatcatgcggggctcattcccggccatcgactggctgaaagcggcaccgtgggcggtggcagtcaccgagccgtaccagctcaggcccaggctgcggtactgtccgggctgcagggtggcgtccgctgccgcttggccccacggcagacggctctgcacgctgccgctgaagctgctgttgctgccggtgtcataacggttatgaccggcgctgatgttccatgtagtgtccgggttatggaaatcgctgtaattcacggtctgctgcaggccgccccggttatctttctgtacgctgtaactcacctggcgactgtctccccacgggatactgatggtggcgtagacctggttctggctacccccgccggtgtactggttacgggcaaacgacaccgaggccgagagtccctgaaggtcgccgagactgaacaccttgttgaggctgagcatgtagttattgttggactgtgcgttccagtaattgagccggcttaccgagagggccgcgctcatgttgagtaccggaacggactggctataagtcacggtgtagctctgtttttcatgccatgcatcgccgccgtcagtggtccgacgctgcaggtactccggcatggacagaaaatggcggtccgagaagcggtatccgacgaacgccagggtactgccggttttatcaaacgttttggcatagttgatacggtagctgtaaccggactgcttctgcccatgcggcaaccgcgcatctgagcgggtgacgtccgcagacagagcgcccaacagccccatattctggccgatcccgagcgccgcggactggtagtcgccggtggaggcaatgaggccgccatacagcgacgtgttgttaaatgctccccaggtggcctccccgagcagaaagtcagggctgaccgtgctgttgttatgcgtcccgccgtacagcggacgtccggcggccaccttatagcgaacctgtccctggcgtgccataaaggggacgctggccgtgttgacctgccaggtccggacgctaccgtcgctttcccggacgctgacatccaggttgccgctgatattctggctcaggtcgggaagctcaaaaggccccggcgacacccgggtctggtacagaatgcgaccattctggctgacggtgacctgtgcattactgttcgcaatgccgctaattttcggggcatacccctgaagagagggcggcagcatgcgctcatcgctggccaaagtgagcccggcaaagcggaaggagtcaaaaatagcggagctgaggtacgtctgtccgagcgtcagttttgagcgcagtgctggcaaggcacggaacagatacgtctgcggcagataaaaatcggactgtgatgcgccctgcccactgtcaaaacggctgtactggtaatcgctccgcaatcgccaggcgccgagattaaacccggcggtgccgtagaggctgtagctggtagaggtttccccctgctgcggcatatagcggttgaccatcaggctgtaatcaagcaggccggcggtgacgccgtcgctccagcgtgaagggggcacccagtccgggtcctgataacgcatccaggcctggggaataatgaaggtcagacgctgattttcagcgctgtaccgtacctgactgtcagcggagcgcagctcaaggcattgcccgtccgggataccggtaacgggtttcaggccatgaataatcttatccttaagacccagcatggccaccatgtctgttgtcacacagatgacggccgcgtcgagtccggcaaccggtacaaccctgaccggatactgttcccgtaccggctggtcattgagccagatatcgagaatatagttaccgggcgccacatacccctcgcggctgaaggccgtgaggtccacgttagacaggttcccgctgtccagcaggctggcattgaactccgtggcctgcgacttcaggacggaaaatgtcagggtaatcagaatggcaagccgggtaattttcatggcatggcgctttcgtgttgtcgtccgtgtaacagacagcccgcaggcacagtcagatataaaagccgtccgatcccctccgtggacggcttctccctgtcgttatttaccgcgtgaaatcacaggtatttcagggtgtaggtgacggatgcgttaacatcgccaggagttgcggcatctgtcagggctatcaggcgggcaaagaagttgagttcgttattcccggcctgcagttgctgggcgtcgccatccggcatcggggtattgggtgtaatcagtgaggtgttgtcacctttcagaagctgcacaccaacatgctgggcactgccggtgctgacgtaagctttacctgaggtatctgctgtgccactgaaagagacggttactttagacattttccctgcggagccggctattgtagtttcattcggatcgaaggcgcagttctgcagatgaatggtgaacggttttgagtccgtggttgcattggcggtattcagtttacggtaagaaatctgtccaaacggaacggtgatcgcatcgtcgcccggtgcgatatcacagggtgagttggtgatggtaccagtgaaaagaattttacctgagccgaacgggcctgctgtgggtgtagtatcggcggcaaatacagaagcaccatacatcataccggcagccgccatggcaagtattattttattacgcatagataatatgtcctttgggtgaatgagaattattttgcaaaggctgaaaacaactctgagggtattaatgaaagcgttcagaaaagattcgtatgaataataaacgcctggtgttaaacgaagcacctgaactttccatcgaaaaatattgatttcagctaatgcctaatcagttgtaagaaaattcttattcaaattaaaacaataaaaatagatcgatacgatcgatgattatgatcgtaatttaagaataatcatcaaagaaatactttttaatgtaattataagcgggtgaatacctaacagacagatattcgcagcggacatgaaatattttgtaatatattatctggaatgtatgttttgcttttccattacactggatatttacaaaacataatactaatcatatataacaatgaaattactggtagcataaaaaactggatataatgcaagtaaaaggcatttaattccaaaacattaacttaataaatcattatgaaccatcataagtggaaggaataaaaaataataaatgaaatgatattcttctgtatttgtgatgggcatcacaatagatataaatgcaggtaccctgacatttctgaacttcgcggatgaaatttaaaaacaatgccgacagcaaagaacaaactggtaatagctgtcagacataatgctgcctgctgtaatgtatacagcaggctgggggatattaatgcgcggcgtcgtgctgcacggagtgcgtgggtgattcctgaactgactgagagtctacaactatgccatcctgagctgatttcagtaacagacctgcctgatagtattttccttcgttcatcaaggaaagcgctgtggtcacatccttacgggtttgctgaagaggaatgagttcctgattttcaataacactgacgcctgctagtttcagggcctctatagtcccttttttatctccttctttcattttctggtttgctttattaatagcatcatttttctggcccgcagggagataatcttctgctaccgtaatcgatgaatttatccgaatatagtggtctccttcaactggggcttttttatctgatttgacatacagattccagtcagtgctgtcatcgttcaggagtttttctgcttgcgcagccagttgttccgccttttgggtgcgaccattaaacaactcgaatcgcgacattccgatatcacgcatggcctgccaggcctgtccggatatcttgtcattattcagagtaacgttatcagtcatgtttgttgcggccataatatttcctgaaaacaggataaccatcagcgcaacgcctggcataatatggcttttcataatccatcatctccacaaagtaacattttttatcggattatcctattcagaaccggtaacccacgccaagattaaaaccattgctattaaggcttccgctgttatgggtagcatcaaaatccgctccctcataacccagagttatagcgacactactgaccggggtataagccacgccagcagaataaccatatccgaccttactgtcagactcatttatcccgtgatcacgctgatgcaataatacggggcccacttgactatacagacttaactggttatttattttccatgaggggcctgcaagcagggagtaataacgggttgttacacgaccattactgctttcatcggaatagcgctggcttccatttagccatgcaaatgaggttgtcagcccccagtccggtgacatttcatagttgtttgccagccgtaccccacgcaacgtcccggcgtgattagtatgggactgggcgtatccaagtgaaaatgtactggcattatcgtctgcccataccggactggctgcagcagacagcagaacaataccggtacttccggctaatagcattttgttcatcttcttctctccggttattttacctgatgccttactggcatgtattaagttaaaatctttccgtgataacaaactataaataaatcttttaaattatgagcactgttacgccagcaaataactttatctccggctgtcgggaggctattcacgaaaatatatccaggccagaaacagtatttaataataaataaactggaaaataaaaactgacaaaaatagaagttcactgatatataccaaaaataatttgagttgctgaaaggcggcaagggagtgagtccccgggagcatagataacgctgtgaccggggagagcaacaaatctgccgggagcagacttgaacgtcgcatgcgacggcccgtcagggcgaggcccatggatggactgagtaatccgtagctaacacataagccacttgaagtatgaagggtatataacgggaaagaaggcctatcggcctggtaaatcaacgtctgtgatttaagttgcaggaaacggctatggagagggggatgcggcagttatcgggcagtaacggcattgttcagtgagtatccaggaaacaaaataaatatcctccggcatagccggaggtttttcagatgcgcctataaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtgttcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaagaagggagcggtactcccttcgtaaacatgtcagaatacgacattttggtactcttttatttattatctggccgtaaaagttatgctgttggcagatatctccagtcaacataaaaaaataccaccagctaaaaatgtgatgcaaaccaccattaagcaggtaaccaaattgactgtgccactaaatccggaaaagagtttgaatccggggataacatctgatgcagaaattagcaccagtcttcgattcggatacccggaatgcgttcaaattcgcggagattgtttgtgacgacgaccagtccgcggctaccggcatggccagcaatcatctggtcataaggcccgacaggtgttcccttgcgggccagttcggcacggatttgaccggtatgtatcgctgcctgtgtatcgtaatccaaaacctcaaggcgggagataaatccctccacgacggcaagattacgctccggcgccaggcttttttcagcaccgtaaatcagctccattaaggtgatggagctgatacacattcgggatgtattgaggttgaagcgttctctgatgtgttcgggcttatttttgatggtgaaaatacaggtattggtatcaagcatgaatttcagcatcaaaatccttcccgttcctgtactgcgggttgttctctggtactcataaaatcagtactggcgccttcgccatcgaaccagctgtcccaggattctccgactggagtaatgattctgcttctgccaaccgcaatgatttcgacatgtttcacatcctccggaaaggatatcgatttaggcaatctgactgcctgggtccggttactaaaaaaaagtgttgtgtgcataactgcctcctttctggatatacaacgcgtatatccattatgagtagaggcgatgtatatgtcaaagagatatacaggaaaaaataatccagtcacatgacgcgcactccgcagggcatccttgtccgactccggcatttctgaatacatccaatgaaggaaataccatgcaaacaatgcataaaaaacatatgtgcccatggcttctgcccggtttgctcggtctggctcggtgtgcgccagtaccgcatacttacgcagccatcattgaggcaggattttatccggaaggtacagatctccagcttgttcttaagataattgagaccgcgcgacaggaaatccgtctgatggactattccttcacctcttgggaggtggtccggttcgaacattcagtgagtacaaaattctccatgtcaaagtgatcgtcagcgacgaccgccacaccgaggtggacgcgtcagaatcgctgatcggacacgtcgcaatctacactctgacttataagccagcctgaaggggcatgttggctttgacgatcaggcaaaaaacaacggcgaataaagtcgtatgatgatcttcacatttatcatcatcagcgttcatattactcaacctgtaatcaacctctggcgtttttctgtatccatcacaaccatttccggtaaaggtaaaaaagggatttgaacctttccggagatgataatgaaggtaaatgcatggacaattttgcttatgtcggcgcatctgacggcctgtgccgtccctggcacagaaaaatatcagaccagcatggacagcgttacggcagaaaaaataagccggattatccagtcggatgtcattccttataaaggcgaaaaccatggagaagttatcagccgcgtatcgtctgcttttctcggaacaccttatcaggcggatacgctcatcggtgggcccggcatccccgaagtccttgtagcgaatttcaacggcgtggactgctttaccctggctgattacgttgaagccctggcccgcagcgataatcagaaatcgtttctgcataatcttgccaggactcgctacgccgcgggcaaagttgcttatctcagccgccggcacttcttctctgactggttcgccgcagcaccgcgtaatgcacgggatgtaacgccggatatcagccctgattatgtcgttgttgacaagcagcttaaccataaacctgatggcggcgagtacattcctggtctgggcatccatcctcgtaaaataaattacattcccggaagagccatcaaccagcaggtcatgaaccacctaaaaaacggggattatatcggtgtctactccccgcttgacgggctggacgtttcacatgtgggtatcgtagttcgccatgatgaacaggtgtggttcaggaacgcctcctcattggccgcaaacagaaaagtggtggacacaccgtttatggaatacatgcattccagaccgggcatcgttgtgctgcgggctgaatgataaagtcattaccggagtcgccagctgataatagccgtccgacataggtattgaaaccctgtgtactgtggggccgacacggaaaattgctgtaaattcgtggatttagtaaatactagaagatatttgtctggagcgggcgaagggaatcgaaccctcgtatagagcttgggaagctctcgttctaccattgaactacgcccgctttgagatgcgtaaagcattataaaccttacgctctggttggcaagagacttactggctgactggcgattaattcgccgtcagcacttcggtttactcccctgcggcggcagataacgcagcggatcgatggccgtcgcccggtagcgaatctggaagtgtagtcttacggatgcggcatccgtgctgcccatcgtagcgattttttgccccgctttaacgctttgtccattattaaccagcatggtgtcattatgagcgtaagccgtaatgtaatcttcattgtgcttaatcatgatgagattgccgtaaccgcgcagctggttcccgacatagacaactttacccgctcccgccgcataaacaggcgttccgcgcgcgcccgcaatatcgatccccttatttccgccctccgcggtggaataaggtaaaatcactttaccgttagcaggccatacccaacaacgctgccccaccggcggccaggaggattttggcaccgaagatgacggtctgaccgcagcagtttttgttgctgttttattgctggttttgcgtgttgaagtgctactctttgcgctgccgcgcactttaattcgctgccccacctcaatagtataaggcggagaaatgccattcagtcgggccagttctttcacgctggttcccgtagcgcgcgatatacgatacaacgtatcgccgcgcttaacggtatagacggagccggaatacgttcctgagccggaattactggaacaccccgccagcagcagccctgtgcataacagcaccgcaatacccaggctatttttgttcaggcgtcctgcgctcaaaaccattcctcactctattgacagacgccttatgatagcagccaaatgccgtatgcccaatccattgacgccggaaaggggccgcgtggatgatgatgccgcgaatatccgatatgccagcataatatcgactcacggcacaatggcgctcgtctgcgttctgtcagggcctgttttggtaatgcctttctttctgttatgcgctacgctgatcgtctgagtatatggcctggccatgctgccgggtcattttaattttcaggagctttcatgactgaggaacatgtcgttttattggatgagcaggataagccttccggcacactggaaaagtatgcggctcatacgcttaatacgcctttgcatctggctttctcctgctggctatttaacgaagatggtcagttgctggtaacacgacggtcgctgagcaagaaagcctggccaggcgtgtggacgaattcggtttgcggtcatccgcaacaaggcgaaaccaccgaagaggcgatcatccgccgttgtcggttcgaactcggcgtggaaattaccgatctcacccccgtctatccgcacttcagctatcgagcgacagatccaaacggtattgtggaaaatgaagtctgtccggtatttgccgcgcgggcaaccagtgtgttacaggttaacagcgaagaggtgatggactatcagtggagcgaatttaaaagcgtatggaaaagccttctcgctacgccgtgggcatttagcccgtggatggtcatgcaagcgtcagacgaacaagcgcgtgaacgactgctcaattactgccagcgttaaagattgcctgatggcgctacgcctgaacgaagagatgccggatggcggctgatgccccatccggcaatttacatcttatttcaccggacgcatcgccgggaacagaataacgtcgcgaatcgtgtggctgttagtaaacagcatcaccatacggtcgataccaattcccagacccgctgtcggcggtaaaccgtgttccagcgccgtcacgtagtcttcgtcgtagaacatggcttcgtcgtcgcccgccgcttttgcattaacctgatccaggaaacgctgcgcctggtcttccgcatcgttcaactcgctaaagccattgccgatttcacgaccgccgataaagaactcgaagcggtcagtgatttccgggttcacatcattacgacgcgccagtggagacacttcagccggatattcggtgatgaaggtcggctgaatcagatgcgcttcagcgacttcgtcaaagatctcggtgacgatacggcccagaccccagctcttctcgacgtgaatgccgatgctttcagcaatcgccttcgcggaatcgaagttgtccagatcagccatatctgtttccggacgatatttcttgatcgcttcacgcatggtcagtttttcgaacggcttaccgaagtcaaacacttcatcaccgtacggaacctgggtggtgcccagaacatcctgcgccagcgtacggaacagagactccgtcagctcgatcaggtctttgtagtccgcatacgccatatagagttccatcatggtgaactcaggattatggcgcacggagatgccttcgttacggaagttacggttaatttcgaatacgcgttcgaagccgccaaccaccagacgcttgaggtacagttccggcgcgatacgcaggtacatgtccagatccagcgcgttgtgatgggtgataaacggacgggcagacgcgccgcctgggatcacctgcatcatcggcgtttcgacttccataaagccgcgagcaaccataaactggcgaataccggccaggatcttcgaacgggttttgaaggtgttacgggattcatcgttagagatgagatccagataacgctggcgatagcgcgcttcctggtcctgcaggccgtggaatttatccggcaacggacgcagcgctttcgtcagcaggcgcagttcggtgcagtggatagacagctcgccggttttggttttgaacagcttacctttcgcgccgaggatatcgccaagatcccacttcttgaactgctcgttgtaaacgccttccggcagatcatcgcgcgccacatacagctgaatgcggccgcctacgtcttgcagggtaacaaaagaggctttacccataatacggcgagtcatcatacggcccgcgacggacacttcaatattcagcgcttccagttcttcagcttctttcgcgtcaaactctgcgtgcagttggtctgaggtacggtcacgacggaaatcgttcgggaacgggataccctgctcacgcagtgcagccagcttctcgcgacgtgccttcatttcattgttaagatcgactacctcgtcagcgccctgtgcgttttgttcagacatgttgattcctcatagccctgctttcaaacttgcttcgataaattgatccagactaccgtccagtaccgcctgtgtattgcgggtttccaccccagtacgcaggtctttaatgcgggaatcgtccaggacataggaacgaatctggcttccccagccgatatcggacttagtgtcttccatcgcctgtttttcagcgttctttttctgcatctccagttcataaagcttcgctttcatctgcttcatggcctggtctttgtttttgtgctgcgaacggtcgttctggcactgcgtcacgattccggttggaatatgggtgatacgcacggcggattccgtacggttaacgtgctgaccgcctgcgccagacgcgcgatagacgtcgatacgcagatccgccgggttaatgtcgatatcgatatcgtcgtccacttccgggtacacaaacgcggagctaaacgaggtatgacggcgaccgccggagtcaaacgggcttttacgcaccagacgatgtacgccggtttcagtgcgcagccagccataggcatattcgccggagattttgatagtcgcggacttaataccggcgacttccccttccgattcttcaatgacttctgtcttgaagccgcgcgcttccgcccaacgcagatacatacgcagcaacatgctggcccagtcctgcgcttcagtaccaccggaaccggcctgaatatcgagatagcaatcggcgctatcgtactcgccggagaacatccggcggaattccaactgcgccaacttctcttccagcgtattcagttccgcgacggcttcgttaaacgtctcttcgtcgtcagcttctaccgccagttccagcagcccggaaacgtcgtccagcccctgagtcatttgatcaagcgtatcgacgatcgcttcgagcgatgaacgctcttttcccagcgcctgcgcgcgctcaggttcgttccagacatccggctgttccagctcggcgtttacttcttccagacgctctttcttagcatcgtagtcaaagataccccctaagaacgttggtgcgttccgtgaggtcctgaatgcggttattcaccgggttaatttcaaacatggtctgatttcttttatttgacttgtcaaaatgcggttataagggcgaaatattagcggatttcgccccttaattacagcgaaagtgttgttaaatcgccccgatcatagcggccaaatatcatcgataataatctgtaaactacggttgccgcgaaactcgttaatgtccagtttataagccagttctacctcccgcacgccgttatccggccaacaggtcgtatcaatattaaatgcgatgccatccaacagcgggccgccgccgacaggctccaccatcaccttgaggtgacgctcgcccaccagacgctgctgtagcagacggaaacgaccatcgaataacggttccgggaacatttgcccccacggtccggcatcccgcaacagttgcgccacttccatagacatctccgccgcgcttaatggaccatcggagatcacctcgccttgcaacagggcaggatcgagccattccgtcaccagctcgccaaaccgttgctgaaactgctcgaatttatgctcttccagcgacaatcccgccgccatcgcatgaccgccgaacttgatcatcagatcagggtaaagggtatccagcctttccagcgcatcgcgcatatgcagcccctgaatcgaacggcctgagccttttagcgtgccgtcgcccgcaggcgcaaaggcgatcaccgggcggtgaaaacgctctttaatgcgcgacgccagaattccgaccacgccctgatgccattcaggatgatacatcgccagaccgcccggaagcgtttcactactgcgctcaagcttttcgcacaggataagcgcttccgcctgcatcccctgctctatttctttgcgcgtctggttaagcgcatccagctcgctggccagaacacgcgcttcgccgaggttatcgcacaacagtaacgccacgccaacggacatatcatccagcctgccggcggcattcaggcgaggccccaacgcgaagcctaaatcactggcggcaagctgctgcggatcgcgattcgatatctccagcaacgctttaattcccggacggcatttcccggcacgaatacgacttagcccttgccaggtcagaatacggttgttagcgtccagcggcacaacgtctgctaccgtacccaacgccactaaatccagcagctccgccagattcggcggcgcgatgttgcgctcgtcgaaccatcctttgtcgcgcaaaaatgttcgcaacgccagcatcaggtaaaacgccacgccgacgcccgccagcgacttagacgggaattcgcagtcgcgcagattgggattaataatcgcttcggcatccggcaacgtgtcgcctggcaggtggtgatcggtcacgatcaccggaatccccaacgtctttgcatgcgctacgccggcgtgggatgaaatgccgttgtctacggtgacgataagctgcgcgccgcgcgccttcgcctgatcgaccacttccgggcttaaaccgtagccgtcttcaaagcgattaggcaccagataactgatgttgtcacatcccaacgcacgcattcccaatacgcttagcgcagtactggtcgcgccgtcggcgtcaaaatcgccaacaacaataatgcgggtaccttcgcgaaaggcgttgtagaggatctccaccgcgttatctatgccgctaagctgttgccagggcagcattcctttcacgctgcgctccagttcgcgggcgctacgaacgccccggctggcatataaacgtcgtagtaatggaggaagatcggcggggagttccgccgtctcatcagcctcgcgccgacgaagttgtctctgttgtttcacgcgtattatttaccactggtctgtttttgatgctcatcaagaaacgctttcatctctttcggtccctgatagccaggcaccacatagccgttactcaatacaatggctggcgtaccgctaacgcccaactgcacgcccaacgcataatgatcagcaatgttcacgtcacagcttgccggtttcacgcccttacctgccatggcgtcatcaaacgctttgtttttgtctttggcgcaccagatagatttcatatcctgctccgcctggctttccagcccctggcgcggaaaagccagataacgtaccgtgatccccagcgcgttataatctttcatctcttcatgtagcttatgacaatagccgcaggtgatatcggtaaaaacagtaatgacatgtttctcatccggcgctttatagacgatcatctctttttccagcgcatttagctggctcatcagcagtttgttcgtcacgtttaccggatgcgcgccgctcacgtcatacatcggcccttgaataatatgtttgccgtcatcagtgacgtacagtacgccgctgtgagtgaggacggttttcatccctgccactggcgaggcctgaatttccgtactctgaacgcccagcttagccagcgactgacggatagccgcatcatccgcatgggccacgcctgaaaacaccgccgccagtaaagtgaacatcataaaacgctttttcataaactatcctttcctgtcagcactcatgcccgcggatggtgctgttgatgaagttgacgcaaacgctccgttgcgacatgcgtataaatttgtgtcgtcgaaagatcgctatgcccaagtagcatttgtacaacgcgcaagtcggcgccgtgattcagcaaatgcgtggcgaaagcgtgacgtaaaacatgcggcgatagtttttcgctatcgattccagccagtaccgcataatgtttaatacggtgccagaaggtctgccgcgtcatctgctgcgcacgctggctggggaataatacgtcaatcgatacgccattgagtaaccatggacgcccatgctccagatacgtttccagccaatataccgcctcttcacctaacggcaccaaccgctctttattgcctttaccgataacccgcaccacgccctgccgcagactgatatcgctcattgtcagccccaccagttccgacacgcgcaaaccggtggcatacagcacttccaacatagctttatcgcgcagctccaaaggttgatcaataagcggcgcctgcaagagccgttcaacctgcgcctcgctaagatctttcggtaaacgctgcggaagcttaggcgaggccaactgcgcgctcggatcatcctcacgatacttttcacggtacagatgctggaaaaagcgccgcatagcgcttaacaggcgtgcggagctggtcgctttgtatccgccctccacacgttcagccaatagcgtttgtaaatcatcagcctgcgccgtcgcaagcgtttttccgcgatgatgcaaccacgcaacgaccatcgataaatcgcgacgatacgcgcttaatgtattttccgccagatttcgttccagccacagggcatccagaaactgctcaatacgcgctaaatcctgttccattcgcgctccctacttcacgcttacttttggtgcattatgcctcattgtgccgtgaatgcagcgattctgttacactacccgcaacgctatagcagaatcgagatgtaacgtaatgaacatgggtcttttttacggttccagcacgtgctacaccgagatggccgcagagaaaattcgcgatatcctcggcccggagctggtgacattacataacctcaaggatgacgcccccgccttaatggagcagtacgacgtgctcattttaggcatccccacctgggattttggtgaaattcaggaggactgggaagccgtctgggagcaactggacgatctcaatctggaaggcaaaatcgttgcgctttacggtatgggcgaccagctcggctacggtgagtggttcctggatgcgctgggtatgttgcatgacaaacttgccctcaaaggcgttaaatttgtcggctactggcccacagaaggctacgaatttaccagcaataaaccggtcattgcggatgggcaactgtttgtcggcctggcgctggatgaaacgaaccagtacgatctcagcgatgagcgtatacagacctggtgtgaacaaattctcggcgaaatggccgaacactacgcctgaaaccttactcgctgtacttccctctcgacggaaccgcgtttacgccgttccgttagtgttggcctgatatcggctgctgtaacagtatccgacgcaactcacgccattccgcttcttccatgctatccgccgccagccataaatgctgatgacgtccagactctgcgcgtaaacgcaacaccatcccgctcttcagtaaccagggcggacgcaagagcgtccagtcctgcccctgccagcgtaagcgcccgtccatgagtagcttgatctctccctggcaggtattaatcctgcgctggctacgtacacagtcaaacacgaccagcgacagtagtatcatccataacggggtataactcagcggccagggcatcaataaaatcaccgcggcaaccagcccatgaatgagcaatgagatccactgagcgcgccatgagacgcgtaaatcagattgccacaggaccacgttcccgattccgtgtctgaatgagtcggaccatctgttccagttcagcgtcagccggtttaccgtgattcattaaccagttaaataaatccgggtcatcactctgcaacaaacggacaaaaatacgcttttcttcatcacttaaactatcgtactcatgttcaaaaaacggcatgatggaaatatcaagttcgcgcataccgcgacgacatgcccagtgaatacgtgctttattgtgaatatccatgttcttcctgcctcgcgaaaatgaagtaccgggctattgtaacgtgtttttggcgttgttttacgggaatctcagtaatctggaacgcgatcgcgaaataaaaggctgggaatcaatatgttcatccattttggataccgcctcgcaaaacgatcaatccgctctcaatgggctatttaaagcacttgcaatgaccgatggctcttttaccattaaccattattgttgcagctaaccaggacattatttatggcttttatctcctttccaccacgtcatccttcatcgtcagcccgcctgccgctgacgctgatcgcgcttgacgactgggcgctgtcgaccattaccggcgtagacagtgaaaagtatattcagggccaggtcaccgctgacgtaagccagatgactgaacagcaacaccttctcgccgcccactgcgatgctaaaggtaagatgtggagcactctgcgcctgttccgtgagcgcgacggtttcgcctggattgaacgccgtagcgtgcttgaagcgcaattaacggagctgaaaaagtacgccgtattttccaaagtggtcatcgcgccggatgacgaacgcgtattgcttggcgtggccggttttcaggcccgcgcggcgctggctaatgtctttagcgaactgcccaatagcgaaaatcaggtggtcagagacggcgcctccacgctgctatggtttgaacatcctgcggaacgattcctgcttgtcaccgatgtcgcgacggccaacatgttaacggagaagttgcatggcgaagccgaactgaataacagccaacagtggctggcgttggatattgaagcaggcattccggtgattgacgcggcgaacagcggtcagtttatcccccaggcgactaacctacaggcgctgggcggcatcagcttcaagaaaggctgctacaccggacaggagatggtcgcacgggcaaaattccgcggcgccaataaacgcgcgctttggttgctggcgggcaaagccagccgggtaccggaagcaggagaagatctggagctacagatgggcgagaactggcgtcgtaccggcgctattctggcggcgacgcagttggacgatggtcagttactggttcaggccgtcatgaataacgatttagaagccgaaagcgtcttccgcgttcgcgacgatgccaacaccctgcatatcgtcccgctgccctactcgctggaagagtgatatcacgttaaaagccggatagcctgatagcgcaacgccatcaggctcgcacgtgctgttctcgtaggccggataaggtgcgacagcgccgccatccggcacgggcatccgggaattatgcctgtcccacatacaaatagatggccaggaagtggcacacgctgccacccagcacaaagccatgccagatggcgtggttataaggtatgcgtttgcaaacatagaaaattacgcccagcgagtaaacgacgccacctaccgccagcagcgtcacgccgcctatcgccagcttaatcgccaactgataaaccactatcagcgacagccagcccattgccagatacgtaaccagcgaaagcactttaaatcggtgcgcaatcgtcaacttgaagaggataccgaatagcgccaggctccagatcacaatcattagtccgcgcgccagcggcgaatccagacctaccagcagaaatggcgtataggttccggcaatgagcagatagatagcgcagtgatcaaatttctttaaccagatttttgcccgctgatgaggaatggcatgataaagcgttgaggcaagaaaaagcaggatcatgctcccgccatataaactgtagctggcgatagccgtcatacccgcattcgcctctaccgcctgaaccaacaacagcaccaggccgacaataccaaataccaatccaatgccgtggctaatactgttggcgatttcctcagccagcgaatatccctgcgtcattaatggtttttgcaccataacttactccggagaaacgttcataacgatgaactgcgcctctagcgtaactgagaatggttccagtgaacacatgttagctaaaataaattcgcaaaattaaattttgtttattattcaataagttaattacaaaaactcaactaacacgcgttcatatttatcaaaggcatttaaaatcaatcacataaaattgcgtctggttgggatagatttcagcaatgacccgtttcagctcatcaagcgacatattttcctgttgcgcatgtttttcgttcagcgtatccagcgtcacagttgacgttcctgtcacttcgattgtgcaaaaatagccatcatcttcgaaccgccccacgcgtagcacatcgcctgctttaaagtgggactcggaggcatcacgaatagtgatggttttacgccctgccagaatgtcattctggaaacgttgaaagaaagtaatgtcgtttggctgcatgtggttatccccctgaatatggccccttgaagtggatgttacgatctgaatgtgttcttgctccgacacgcgagcatcctggaattttgcgtacgctttacatgccacttggtgcagaatgaatgataacagactaaataaattgagattatgcaacaatgagaaaactcaccttgccaaaagattttttatggggcggcgcggttgctgcacaccaggttgaaggcggctggaataaagacggtaaaggccccagcatctgcgacgtgctaaccggcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacctctattgcctggacgcgtatcttcccgaatggcgacgaatcccagccaaacgaggccggtctgaaattctacgacgacatgtttgatgagttactcaaatacaacatcgaaccggtcattaccctttctcactttgaaatgccattacatctggtacagcactacggcggctggaccaatcgtaaagtggttgatttctttgtccgttttgctgaagtcgtgtttgaacgctacaaacataaggtcaaatactggatgaccttcaacgaaattaacaaccagcgaaactggcgcgcgccgctgtttggctactgctgttccggcgtggtgtataccgagcatgagaatccagaagaaaccatgtatcaggtcttacatcatcagtttgtcgccagcgcgctggcggtaaaagcggcacgtcgcattaacccacagatgaaagttggctgtatgctggcgatggtcgcgctgtatcctttctcctgtaaaccagaagatgtgatgtttgctcaggagtcgatgcgtgaacgctacgtctttaccgatgtgcagctgcgcggctattacccgtcctatgtgttgaacgagtgggagcgccgcggatttaacatcaaaatggaagatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggcctgcgttattcattgtgtgaactgtacgaacgctatcaaaagccgctgtttattgtcgaaaacggttttggtgcttacgacaaagtagaagaagatggcagcatcaacgacgactaccgaattgactacctgcgcgcccatattgaagagatgaaaaaagcggtgacttacgatggtgtcgacctgatgggctacacgccgtggggctgcatcgactgcgtgtcgttcaccaccggtcagtacagcaagcgctacggcttcatctacgtgaacaagcacgatgacggtacgggcgatatgtcgcgttcgcgtaagaagagcttcaactggtacaaagaggtgattgccagcaacggcgagaagctttaactcctgcacgttacccgccagtcggcgggtaacactttgaacgagtcttaccaggtcttacctattttaaattcccagcgtacatcttccattttggttggcgacttcgcttcctgcattaccgggaagaaggctccggcaccaaaccataatttcagtgaatcgacggcaatattaaatgacggaccaacaacccattcggtagttccagaatggttattaattacgctgccattagacagttttttcgttccagaggcattattgctgtaggcactttccagaccaagatccagcggtaaatcgctaaacatataccgcacctgggtattccactggaattcgttacctcgtttcacgtcctggttaccgcgctcaaatggtccctgatatacaaaacccatatcccctttaatgttaggagtaaataattttgttaaagtgagtgttactcttcctccccaggcgctattcccaggcaaatgattatctccatcttgcccggtgggtagtaatactgccccacctaccgtaacccaaaacggatcacctcttcgctggctcattaaagcataattgacccccaccgattggtcgcccattccctctatgtgctcaggagacagattgtctcgtttgttattgatataggaacccacagttgataattccagtctgtcggtcaaaccgtaacgaatcttcaataaccatatctgggagtaaacatccggacttccatgcccctcgatttgatgatctttatcgcgaaatgagctattcatggcggttaataactttccttccggcaatactgaaccaccagaaatagcggtattaactggtgcacctaatagattactgggattattttctccgttagctgccattgcattcattaatagaaaatatgtcattaatggcagaaatataaatcgtttcattattccctccaggtataaaaaacaaagtgctaagttaataaatatttacgttatttatgcttatctttaatttataatttaaattaataacttgatgaatttaatatacggaaatttttgtaactatattgagaggtaaataacgattccggagagaaactatttgtaaccacatgtaaatataccgtgttatttttattaaataacagcaaggtaaaaatgatgcacaatgaatcattagactctaaaaaaccggtaatttaattctggctaatacactgatacaaacgccaggttgcctgacaggagccaacgatttactgtaatatattgaattagtaacactttgtagcctgaataaggcgctcacactgcatccgacacaaacaaagcgcattttattaacaagctgaaaaggcgccgaagcgcctttagaagacagtcgaatcagtaaattactggtagtcgctaatcggtacgcaggagcagaacaggttgcggtcaccataaacatcatccagacgtttcaccgtcggccagtatttgtctgccacgcctgccgggaatacggcaacttcacggctgtacggatgcgcccactcggcgaccagttcgctctgaatgtgcggcgcgttcaccagcgggttatcttccagcggccagacacccgctttcacctggtcaatctctgcgcgaatagccagcatcgcatcgataaagcgatccagctcggccttaccttcagattccgtcggctctaccatcagcgtgcccgccaccgggaacgacatggttggcgcatggaaaccatagtcgatcagacgcttggcaatatccagctcgctgatgccggtttcttctttcaatgggcgaatatcaagaatacattcgtgcgccacacggccatcgcgaccggtatacagtaccggataggcatctttcagacggctggcaatgtagttagcgttaagaatcgcgacctgacttgcctgcttcaggccttctgcgcccatcatgcggatgtacatccagctgattggcagaatggaggcgctgccgaacggcgccgcagacaccgcgccctgacgggtgagcatcccttcaatttgcaccacgctatgacccggtacgaacggtgccagatgcgctttcacgccgatcggtcccatgcctgggccaccgccgccgtgcggaatgcagaaagttttatgcaggttaagatgcgaaacgtccgcgccaataaagcccggtgaggtaatgccgacctgagcgttcatgttcgcgccgtcaaggtaaacctgaccgccgaactggtgcacaacttcacacacctcacggatcgtttcttcatacacgccgtgggtggacggataggtcaccatgatgcaagaaaggttcgcagcatgttgttctgcttttgcccgcagatcgtccaggtcgatgttgccgttcttatcacaggcgactaccaccacctgcattcctgccatatgtgcagaagcagggttagtgccgtgagcagaggccggaatcaggcagatatcgcgatgaccttcgttgcggctttcgtgatagtgacgaatcgccagcagccccgcgtattccccctgtgcgccggagttaggctgcatacagacggcgtcgtacccggtgagtttcaccagccagtcagaaagctggctaatcatctgatgatatccttcggcctgttccggcgggcagaacggatgcagttcagcgaattccggccaggtgataggaatcatctcggcggcggcgttcagcttcatggtgcaggaacccagcgggatcatcgcctggttcagcgccagatctttacgctccagcgagtgcatatagcgcatcatctcggtttcgctgtggtaacggttaaataccggatgcgtcagaatcgcatcgtcacgcagcatactttgctgaatggaacggctatcaagcgccacgtctttatccagtgtttcaatgttcagaccgtggctgtcgcccagcaaaacattgaacaactgcgccacattctcacgggtggtggtttcatcgagcgtaatacccaccgcgttatgaatatcgctgcgcagattgatctctgccgcttccgcacgcgccagtaccgcagctttatcagccacttccacacacagggtgtcgaagtagtgcgcatgacgcagctttaagcctttctgttgcagacctgccgccagaatatcggtcaggcggtggatacgattcgcaatgcgcttcagaccgaccggaccatgataaacggcatacagactggcgatgttagccagcagtacctgcgaggtacaaatgttggagttcgctttctcacggcggatatgctgctcgcgagtctgcatcgccatgcgcagtgcggtattgcccgccgcatcttttgagacgccgataatacggcctggcatggagcgtttaaattcgtctttggcggcaaagaacgccgcatgcgggccaccgtaccccatcggtacgccgaagcgttgcgcagagccgaaaacaatgtccgcgccctgtttgcccggagccgtcagcagcaccagcgccataaaatcggcggcgacgctgaccacaactttacgggatttcagctcagtaatcagtgcgctgtagtcgtgaatttcgcccgtggtgcctacctgttgtaacagcacgccaaacacatcctggtgatccagtgctttcgccgcgtcatccacaatgacgtcaaagccaaaggtttcggcgcgagtacgcacgacgtccagagtttgcggatggacatcagaggcgacaaagaaccggttggcatttttcagtttgctgacgcgctttgccatcgccatcgcttcagcggcggcggtcgcttcatccagcagcgaggcggaagccatgtccagccctgtcaggtccagcgtcacctgttggaagttgagcagcgcttccagacgcccctgagagacttccggctgataaggagtgtaggcggtgtaccagcctggattttccagcatgttgcgcaggataaccggcggtagctgcacggcggtgtagcccatgccaatgtacgacgtgaagcgcttgttacgcccggcgatggcttttaattccgccagtgcggcatattcggttgccgcctctccaacctgcggcggagtcgcgagctgaatgtctttcggcacaatctgacctgtcagcgcgtttaacgactcggcgccaaccgcattcagcatctcttgttgctgtgcggcgtccggtccgatgtggcgttcaatgaaagcgccgcggttttcaagctggcttaacgtctgtgtcatgggcgatggttcctgaaacgtgcagtgaatcgtgattgtctctaactcaattgcccggtggcgctgacgcttaccgggcctacgcgtgcgaaaacgaatacgcaaaatcattcgcgttgcagtgagtaggccggataagcattagcgccatccggcacaacattattcgtcttctaacaatgcctcatacgcggtggcatccagcagcgattcaagttcgctttcatcgctggctttgattttaaagatccagccaccggtatacggttcgctgttcaccagctccggggagtcgctcagcgcatcgtttaccgccacgatctcgccgcttaccggcgcataaatgtcggacgccgcttttacggactccgccacggcgcagtcgtcgcccgcgcttacggtcgcgccgacttccggcagatcaacaaaaaccatatcgcccaacagctcctgagcgtgttcagtaatgccaacggtgtaagtgccatccgcttctttacgcagccattcgtgttctttgctgtatttcagttctgcgggtacgttgctcatcaattaatctccaaaaaaggatgaatcacgcgacggctttgccgttacgcacaaaaacaggtttagtcacttttaccggcatttcacggttacgaatttgtacaatcgccgtctcgccgatgcccgccggaacgcgcgccagcgcaatgctgtagcccaacgttggggaaaacgtcccgctggtgataatgccttcttgctgattgccctgcgcatcggtaaaacgcaccggcaattcattacgcaatacgcccttctcggtcatcaccagaccgacaagctgctcatggcctttttcacgctgcatctccagcgcctcacggccaataaagtcgcggtcagcaggttcccaggcgatagtccatcccatattagccgccagcggagagataccttcatccatctcctgaccgtacaggttcatgcctgcttccagacgcagcgtgtcgcgcgcgccaagaccgcacggcttcacgcccgcctccaccagcgcacgccagaaatccgccgctttttcattcggcatggcgatttcatagcctgcttcgccggtataaccggtggtggcgataaacaaatcgcccgcctgaacgccgaagaacggcttcataccttctactgcatggcgctgttggtcagtaaacagagtcgccgctttttcctgcgcattcggcccctgtaccgcaatcagcgacaggtcgtcacgaacggtgatgtcgatggcataaggttcagcgtgttgggtaatccaggagaggtctttttcgcgggtggcggagttaacaacgagacggaagaaatcttcagtgaagtagtagacgataaggtcatcaatcacgccgcccgatgcgttaagcataccggagtagagggctttacccgtcttcgttagcttcgcgacgtcgtttgccagcagataacgtagaaactctcgtgtgcggctgccatgaagatcgacaatggtcatatgcgatacatcaaacatcccggcatcggtgcgcacagcgtggtgttcatcaagctgagagccgtaatgcaggggcatcatccagccatgaaaatcgaccatgcgggcgccgcatagcgtgtgttgttcgtacaaaggcgtctgttgggccatcttttcctcgttgaattagcgggggctaacaaccattttcatgggaaatcttcgccacgaaacctggcatcgacgccctttttcctgcgccgacgcaaacgttctcttgctcctgaacttaccaccgaaccaggcgctaaaccataaggctgaatttaccatcacattagcttatgactaaaaaacgccaaaaccccatcagcacaaaaaaccactattacgctaaataacctccataaaaatgaagctgatacgatttatcacaacataaattaatattaaatgtggaaaaaatgtcgaaaatctcgttcgcaaaaaatagtggcattagaaaatataatgcgaaataagcggtgaaattagattatttcaaacgaggaaagccccccggcgcgatagccgggaaagcaaagtgtgacgggtttcaaactcttgctggcgtgcagtcagacgcttaacgaagccattgcggaaggtcgtttagccccattgcctggcgaagcagttggggtttgacgccggggagcgtgtccgccagtttcagtccgatgtcgcgcagcaatttttttgccgggttttcgccggcaaacaggtcacgaaaaccttgcatcccggcaagcatcatcgccgcactatgtttacggctacgctcataacgacggagataaagatgttggccaatgtctttgccctggcgctgaagccggcgcagatcgtccaccagttcggccgcgtccataaagccgaggttgacgccttgccctgccagcggatggatggtgtgcgcggcatcaccgaccaacgccagacgatgcgcggcaaactggcgagcatagcggcccgtcagcggaaaaacctgccgttcgctttccaggcggcataagcccagccgattatcgaaggcgatagtcaacgcctggttaaacgcctcgtcgccgctctgttgcatacgctccgcatcctgcggagaaagcgaccagacaatggaacacagatgcggatcgcttaacggcaaaaacgccagaataccttcaccatgaaacacctggcgagcaaccgcgccgtgcggctcttcggtgcggatagtcgctaccagcgcatggtgacggtagtcccagaaagttaagggaatatccgctttgttacgcagccaggagttggcgccatccgcggcaatcaccagacgcgcggttaacatcgcgccgtcttttaaagtcaggaaggcgtcgttctctccccaggcaacctgctgtaactccgctggcgccattaaggtgatatccgccgcttgctgcgctttttgccacaatgcgtagtgaatgacgctgttttcaacaatatgccccagatggctatatcccatgcttgcgtcatcaaacgtaatacggccaaagctgtctttatcccagacttccataccgtggtagcaacttgcccgtcgcgccacaatgtttgaccatacgccaagacgggtaagcagtttttcgctggcggcattaatcgccgacacccgaagctgaggcggcgcatcgttcgccaacggctgggggacaacgtgatccagtaccgcaacgcgcaaaccgctcccctgcaagccgcaggcgacagccagtcccaccatgcctccgccaactattgctacatcaacactttgcactatttactcctggaaaccggaacaatcaaaaccgtaggccggataaggcgaagccgccatccggtatttttacgaacacgatgccggatggcggcgtgaacgccttatccggcctacagatcggcttaacgcgcaacccaacctaaggtccgctgtgccagcgcatcgcgcgcaggtggtaataattccatcgccattaaaccgatattgcgcccaataaccagcggcgcccaacgatttgcaaacagatggaccagaccgttcgttacgccaatcgtcgtatcccggtcaacctgacgacgctgctgatagcgcgataacacgtgccaggcgccaatatcctcgcccgcgtcctgtgccgcgaccagcgtttccgccaggctcatgacatcgcgcagaccgagattaaacccttgtccggcgataggatgcaacgtctgcgccgcattgccgaccacgacagtccggtgagaaaacactttcgccgccgtagtcagggcaagcggatacgcgctgcgcttaccggcctgagtaattcgccccagccgccagccgaacgcggcctgcaatgcatggcagaactgcgcgtcggaccagctcagcacctcatcgcgctggtcgagcgggtgacaccaaaccagcgaacatcggccatgcgacatcggcaacatcgccagcgggccattgggggtaaaacgttcaaaggcgcgtccctggtgcgggatagcggttgcgacattcgctatcaccgctaactgttcgtaaggctcctgatgccagtcaacgccgcaggctgacgcgagcgcggagtgggtaccgttagccgccaccagcacgctgccagctatcacattgccgttttccagagtgacgttaacctgctgttgggtacgcgacacgctggctacgcgctccgggcagtgcagcgtaacgcctggcgctttacgcaagagcgcaaacagacgcagcccgatatcatgcagctccgcaacgtgccccaacgctgccagactgtagtcctgcgcgtcgagagtcacaaatccggcatggccgcgatcgctgacgtgtacggtgttgattgccgttgcgcaatcggaaatcgcctgccagacgccaattcgcgccagttgctgacaagtgcccgccgccagcgcaatcgctctggcgtcaaagccgggatgaccgtcggcttcaggcgctttcgcttcaatcaggtgtaccggcaacgtcccatgactgaactgagagatggccagcgccagcgtcgcgcctgccatgccgccgccaacgataatgacgctcattgctgccgcgccgccgccattaatgcctcaatgtcatccgccttcttcacaacgccagcggtcaggttttcattaccggtttcggtaatgacaatgtcatcttcaattcgaacgccaatgccgcgatacgcttccggcacgtcggcatccggcgcgatatagaggcctggctctacggtcagcaccatgcccggctccaggatgcgggagcgatccggcccataaacgccgacatcatgaacatccagccccagccagtggctcaagccatgcataaagaaaggacgatgcgcattttcggcaatcagttgatcaacctctccttgcaaaatccccagcttcaccagcccggttatcatgatgcgcacgacttcgccggtcacctcctgaatagaggtaccaggacggaacagtcgcaggctggtctccagcgattccagaacgatgtcataaatttcacgctgggctagcgtaaatttcccgttcaccgggaaagtacgcgtgatatcgcccgcgtaacctttatattcacaacctgcgtcgataagcactaaatcgccgtcgcgcatttcactttcgttttcagtgtaatgcaggatacagccattttcgccgctgccgacaatggtgttataggagggatagcgcgcgccgtggcgattaaattcgtggtgaatttctccttccagctgatactcaaacatccccggacggcatttttccatcgcgcggatatgcgccagcgcgctaatttccccggcgcggcgcaggacagcaatctcttccggcgatttgaacaggcgcatctcatggacgatcggtcgccagtcagtcatggtggccggcgcggtcagattctggcgggagcctttacgcagcttctccagcgcagccagaacaatctcgtcggcatacgcatattcgccctgcgcgtggtacaccacatccagaccattaagcaactgaaagagttgctggttgatttcgctaaacgccagcgcccggtcaacgcccagtttttccggcgcggcatcctgtcctaaacggcgaccaaaccagatttccgccgtcaggtcgcgaacgcggttgaacaaaacgctgtggttgtgggtgtcatcactcttaatcagtaccagcacggcttccggttcgttaaaaccggtgaaataccagaagtcgctactctggcgatacggatattcactgtctgcgctgcgcgtcgcctccggcgcggcaaagatcagcgcggcgctgccgggctgcatttgcgccagtaatgcctggcgacggcgttggtattcctgctgagtcatgacatggcctccatttcgttttttcttagtgtagcgtcggtttacgcacttccggcgcggtcggctgttggcgcgtgaaagtgtcatgacataacagcgccgcaacacggacatattcgatgatctcttcgagcgacatctccagctcttcctgatcttcgctctcatcataaccaagctgcgcaatattacgcaggtcgtcaatcgcttcacccgtttcgccggtgactttatcaagtttaggctgcgttacgccgaggccaagcaaaaagtggttaacccacccggctaaggcatctgcgcgatcgaatacgctgacatcgtcgccttcaggcagataaagctgaaaaagaaagccgtcgtcttccagcgcgtcgctggtcgccgcgtgcattttgcgcagcgcctgagcaagctcatgcccgaaggccagaccttcgttcgtcaggtcgtgcaacagcggctgccatgagctgtcgttgttgccgccgcaaatcatcccgctgattaaaccatgcatttcagccggggtcagaccggccccttgttgattcaaaaaccggttcatttcgttgtaaccaggcatttcgttctgtatagacataagcattcgtcatcaaagggaggatattcatgatatgctaccactttggaccctggtgaaccagaaaagggcttgtatcttcacaccagggtagctatagtgtcgccccttcgcggaccctgggtctggagacgaaggcagcgcagtcaatcagcaggaaggtggcatgtctgcacaacccgtcgatatccaaatatttggccgttcactgcgagtgaattgcccgcctgaccaaagggatgcgttgaatcaggctgcggacgatctgaatcagcggttgcaagatctgaaagttcgcactagagtcacaaatactgagcagttggttttcattgccgcattgaatatcagctatgagttaactcaggaaaaagcgaagacccgcgattacgcggcgagcatggaacaacgtattcggatgctacaacagaccatcgaacaggcgttgcttgatcaaggtcgcataaccgaaaaaacgggccaaaactttgaataacacttttcgctttactatggtaaagtgattgtgaaaacagaatttctctgagatgtttgcaagcgggccagtcccctgagccgatatttcataccacaagaatgtggcgctccgcggttggtgagcatgctcggttcgtccgagaagccttaaaactgtgacgacacattcaccttgaaccaagggttcaagggttacagcctgcggcggcatctcggagattccccttctgactggcgacagccatgacgcaacttcccgaactctctttatcacgacaagaaatccgccggatgattcggcaacgtcgccgtgcgctaacgccagagcagcaacgccgttttggtcaacaggccgccgcccgaatgctcagctttcctcccgtcgtgatggcgcacactgtcgccgtgtttctctcctttgatggcgaactcgacacccagccgctgattgaacagctatggcgagcgggcaagcgcgtctaccttccggttcttcatcccttcagccctggcaacctcctgttcctgcactattatccgcagagtgtgctggtgaccaaccgcttaaagattcaggagccacggcttgatgtccgcgacgtattgccgctggcaaagctggatgtgctggtaacgccgttagtcgcgtttgacgaagacgggcagcgcctggggatgggcggcggattttatgaccgtacgttgcaaaactggcagcagcataagatcctacctgtgggctacgcgcatgattgccagttagtggaaaagttgccggttaaagagtgggatatcccgctgcctgcggtggtgacgccgtccaaaatttgggagtggtagccgtgttttgtcgattgacagcgtcgcttttttgacctaaatttctcggtgaagggtgagggaggcgaacctccctcctgcgtactcactgttaatatgctgggcaagcgatgattaacaggatcagcagcatgatgacgtatctcatcatcgtccctttcctttttagagcccctgcctcggtaggggctttcccgtttcagcgctatgctgagcccttatcgtaaattccttttattgctgtacaacacgcaacgctgcctttaattaccaattgcggcaaggctcgaaaacagaatgtatgcgttacacgaagagatgttgaggcagggaaaccagagaaaggatgggcaggtcatctcctgcccatttagcggaaattagtacagcagacgggcgcgaatggtgcccggaatcgccttcatcgccagcagcgctttctccgccacatcgccatcggcttctatatcaattaccacataccccattcgggcggaggtttgcagatactgtgcggcaatgttaacgccctgctcggcaaagatctggttaagcgcggtcaatacgcccgggcggttttcgtggatgtgcatcaggcgacgaccaccgtgcagcggcagcgacacttccgggaagttcacggcggacagcgtcgagccgttatccgagtacttaatcagttttcctgcgacttccagaccgatgttttcttgcgcctcctgcgtcgagccgccgatatgcggcgtcaggatcacgttatcgaattcgcacagcggagaggtaaacggatcgctattagtggccggttccgtcgggaagacgtcgatagccgcccccgccagatgtttcgtcgccagcgcgtcgcacaaagccgggatatctaccaccgtaccgcgcgcggcgttaatcagcagcgaacccggcttcatcagggcaatctcttttgcgcccatcatgtttttggtggaggcgttttcaggtacgtgcagactgaccacatcgctcatattcagcaattcagacagatgctgcacctgagttgcattaccgagcggcagtttattttcaatatcatagaaatagacatgcatccccagcgattccgccagaatgcccaactgcgttccgatatggccgtaaccgataatgccaagctttttaccgcgcgcttcgaacgatcccgccgccagtttattccatacgccgcggtgcgctttggcgttcgcttccggcacgccgcgcagcagcagcaatagctcgccaatcaccagctccgccacggaacgggtattcgagaatggcgcgttaaagaccggaataccgcgttttgccgccgcatttaaatccacctggttggtgccgatgcaaaaacagccaatcgccaccagcttctctgcggcgttaatcacttcttctgtcagatgagtacgggatcgcagaccgatgaagtgggcatcgcggatggacgctttcaactgttcagcgtccagcgcgcccttgtgatattcaatgttggtgtaacctgccgcacgaaggctttccagcgccttttgatgcaccccttcaaccagcagaaatttaattttatctttctccagcgatacctttgccatttccccgatcctgtcttttttgccatctgatgttgtgtgtggatttgcatccgtccttcaacatatcaaaaaaaattatcacggcaatatgaacgtttgcgccagcgtcgtgaaggaatcgcatacagcgggaaatagcagatgaaaataccgggaataactttttctttggagggatcggcagggcaaacgattaaacgtgatacatgtcaccaaatttgccctgaccgaattttttacgcggcaggaaatacgcctggcgggatcattttacgatggttttcaccccgtccggcgtgccgatcagtgcgacatcggcgccacggttggcgaacaaccctacggtcacgacgcccggaatcgcgttaatggcgttttccagcgcgatgggatcaaggatttccataccataaacatccagaatcacgttgccgttatccgtgaccacgttctgacggtactccggacgcccgcccagcttcaccagttgacgagcgaccgcgctgcgcgccatcggaatcacttcgaccggcaacgggaatttgccaagaatatccacctgtttagaggcatccgcaatacagataaatttctctgccacggaagcaataattttctcacgggttaatgccgcgccgccgcctttgatcatctgcatatgaccgttgatttcgtccgcgccgtcgacatagatgcccaggctatccacttcgttgagatcaaacacatgaataccgaggcctttgagtttttcagtcgaggcgtccgagctggagaccgcgccttcaatctggcctttcattgtgcccagcgcatcaataaagtgtgcggccgttgagcctgtaccaacgcccacaatggtgccgggctgtacatactgaagtgccgcccatcctaccgcttttttcagttcatcctgcgtcatagatcgtttcgcctgtggtgtgaaaatacagccgcattatagaacattgtcgggaaaaatctccgtgtccgtacacaggctacggatttcatctgtaccgacggcaaatttatgtcatagtgcggaaaaaaataacaggagcatgacacaacaatgaaacgtccggactacagaacactacaggcgctggatgccgttatacgtgaacgaggattcgagcgcgccgcccagaagctgtgcatcacgcaatccgccgtctcacagcgcataaaacagcttgagaatatgttcggacaacctttgttggtgcgtaccgttcctcctcgccccacggagcaagggcaaaaattactggctctgctgcgtcaggttgaactgctggaagaagagtggctgggcgatgaacaaaccggctctacgccgctgctgctgtcgctggcggttaacgccgacagtctggcgacctggctgcttccggcgctggcgccggtactggcggactcccctatccgtctcaatttacaggtggaagatgaaacgcgcacgcaagaacgtctgcggcgcggcgaggtggtgggcgcggtgagtattcagcatcaggcgctacccagttgcctggtggacaaactgggcgcactcgactatctgtttgtcgcgtcaaagccgtttgccgagcgctatttccccaatggcgttacccggtcgtcgctgctaaaagcgcccgccgtcgcgttcgaccatctggatgatatgcatcaggcctttttgcaacagaatttcgatctaccgcccggcagcgtgccgtgccatatcgttaattcatccgaagcatttgtacagcttgcgcgtcagggcacgacctgctgcatgatccctcacctgcagattgagaaagagctggaaagcggcgagttgatcaacttaacgcctggtttgctgcagcgccggatgctttactggcaccgctttgccccggaaagccggatgatgcgcaaagtgaccgacgcgctgctggagtacgggcacaaggtgctgcgtcaggattagcctctctatgaatgccggatggcggcgtgaacgtcttatccggcctgcatgacccattattccctcgtcacttctttgaagttcatcacaaaatcattgcgttcaggcggcaaaaaacgacgcgccattggctattttttgctggcgacaaggcgattcaaaacgctcaccgtattagcaaatcttcatttcaatgcgtaatacggagcaaaaaacgagaacaccgggagaaaacgcggcctggaagcgcccaggccgggtgagattactgcgtgctggcggccgttgtcgacgtctgccctgttccaggttcaagctggaataccacatcgacctgatcgtcgaactgaatggtcggctgctcgtaagtttcctgcgcagataccggcgcagcatctgcggctttcatcattcgcaccaccggactcggctgataattagagacatggtaacgaacgctgtaaaccggccccaatttgctgttaaaaccggctgccagcgcttgcgcctgatgaatcgcgtcatcaatggcggctttgcgggccttgtctttataggcgtccggttgcgccacgcccagcgataccgaacgaatctcgttcagacccgccttcagcgcgccgtccagcagagaattaagtttatctaactgacgcagcgtcacctcaacggttcgcaccgcacgataccctttcagaatgcttttaccgttttggtaatcataatccggctgcgtgcgcagattcgccgcgctaatgtcttttttcgcaatctgattttgctcaaggaaggaaagatattgcgccacgcgctcatcggcctgcttcttcgccgtcgccgcgtccttcgccgcgacgttcacttcaatcgctaaggtggcgatatcaggcacagcatcgacgcttgccgtaccggaagtcacgatgtgcgggccttccggcaattcgcttgcctgcgccgacattgcacttaaacccactaatgccgccagggccatcactttgaacttcacagtctctcctccatattgcagtcattgccctgatatacagggcgcatgcaggcaagcttagcggatatcggcctgttgtccatcagacaacgcttagttgaaaagcgcgtgcatatgcgcgacgccttcccgcgccagttggaaggcgataagccacatcaccaccccaaccagaatgttgataatgcgttgagctttcgccgtacgcagtcgaggcgcaagccaggccgccagtagcgctaacccaaaaaaccataagaacgacgcgctaatcgtgccgagggcgaaccagcgctttggctccatagccagttgtccgccgagactgcccaacacgacaaacgtatccagataaacgtgcggattcagccacgttaccgccagcatcgtagcaataattttccagcgcccctgcttcataacctcggcgctggccagctccagattactgctcattgccgttttcagcgcgccaaaaccgtaccataacaagaacgcgaccccgccccatgtgaccagcgccagcagccacggcgactgcatcagcaacgcgctaccgccaaaaataccggcgctaatcaggactaaatcacttaacgcgcaaagcagcgctatcatgaggtggtactggcgacgaattccctgattcatcacaaacgcattttgcgggccaagcggaaggatcatggcggcgccaagggcaaacccttgaaaataataagatatcacgttaactaccctgagctgtttttcttaaaggcagactatagcgcgggaatattattagcggaaattgataattttaatcactaataagaaaagctaataaagagactgaataacggatagcggctacgcttatccgctcaataaccagagaatactggaggcggataagcgcagcgccggcaggcagcgcgggagaaaattactccgcggcgttatctttcacgcgtttaaaattgacgtccatctgcgggtacgggaagctaataccagcggcgtcgaattcacgtttaatacgttccagcacgtcccagtagacattttgcaggtcgctgcttttactccagacacgcaccacaaaattaattgatgaggcgcccagctcattcaaacgcaccgtcatttcgcgatcttttaaaatacgatcgtcggactcgataatcgtcgttagcagctgtttcacctgatcgatatccgaatcgtaggccaccccaataatgaattcgttacggcgaaccggctcacgagaatagttgatgatatttcccgcgataattttgccattcggaatcacaataattttgccgtctaccgcgcgcattgtcgtggaaaagatttgcacgttcagtaccgtaccggcaacgccgcccaaatcgacatactcaccggcgcggaacggacggaacataaccagcaataccccagccgcaaggttagaaagcgatccctgtaatgccaggccaacggctaaaccagcggcgcccagtacggcaataaccgaggcggtttgaacccccacgcgacccagagccgcaatcagcgtaaaagcgataaccccatagcgcaccagcgcagaaagaaagtcggccactgtcgcatcaatatgacgcgcacgcatcagacgatttaccgtattggagatcacgcgcgctacaatcaagccgatgatgataatagcgatagccgcaacaatattcacagcatagctgagcaataacgcctggttgcgtaccagccaggtgcccgcaccatttatgctgtcgacaacattcaaatcttccattcaatattccttggtcatagcaaaacaagcaaatgagatcattctcacgaaaagaactttttaaaggtaaacaaaaacagaagaatatgccatttttcggcatcatcccaaaaaaggcaggtacattgtgagttggccggatgaaagcgctaactaacgccgctctccggaaataacgataaaaaaatggcttcccaagggaagccatttcaatcagcagactatattacagaacgtcaatcgcgttcagttctttaaatgctttttccagacgagcgatcatcgaagtctggccagcacgcagccatacgcgcgggtcatagtatttcttgttcggctgatcttcgcctttcgggttgcccagctgaccttgcagatacgcttcgttttctttgtagtagttcagaacaccttcccaggttgcccattgggtatcggtatcgatgttcattttcactacgccgtagcttacggagtctttgatttcctgagcagtagaaccggaaccgccgtggaaaacgaagttcaggctgttgtgcggcaggttgtgtttcttagaaacatagtcctgagaatcacgcagaatggtcggggtcagaaccacgttacccggcttgtaaacgccgtgtacgttaccgaaggaagcggcaatggtgaaacgcgggctgattttgctcagttcagtgtacgcgtaatcaacgtcttccggctgggtgtacagagcagaagcgtccatgtggctgttgtccacgccgtcttcttcaccaccggtgcaacccagttcgatttccagagtcatgccaattttggacatgcgcgccaggtatttggagcagatttcgatgttttcgtgcagagactcttcagacaggtcaatcatgtgagaagagaacagcggtttaccggtagccgcaaagtgtttttcacccgcgtccagcaggccatcgatccacggcagcagtttcttcgcgcagtggtcagtgtgcaggataaccggaacgccgtagtgttcagccatctggtgaacgtgatgcgcgccagagatagcgcccaggattgccgcgccctgaggtacgtcagttttcacgcctttacccgcgatgaaggaagcgccgccgttggagaactgaacgatgaccggtgctttaacttttgcagcggtttccagaacagcgttgatggaatcagtgcccacgcagttaactgccggcagagcaaaattgttttcttttgctacctggaacactttctgtacgtcatcaccagtgatcacgcctggttttacgaaatcaaaaattttagacatgtttcgttgtcctgtatcgtcgggctttgggaaaaaacacgggccgccctgaatgtcagatcggcgataaatcaacgggcaggaatccctgcccgtaacgattacttcttagcgcgctcttcgagcatcgctacggctggcagaactttaccttccacgaattcgaggaatgcgccgccgccagtagaaatgtaggaaattttgtcagcaatgccgaacaggtcgattgccgccagggtgtcgccgccgccagcgatggaaaacgcttcgctatcagcgatggcattcgccacgatttcagtccctttacggaagttcgggaactcaaacacgccaaccgggccgttccacagaatggttttggcattcttgaggatttcagccagctgctgagcggaagcatcgccgatatccaggatctgctcgtcttctttcacgtcgttaacggatttcagagtcgccggtgcggtttcggagaactcggtggcaacgcgaacatcggtcggaaccgggatatcgcaagtggtcagcagacgttttgcttcgtcaaccaggtcagcttcgtacagggatttaccgacgctgtggccctgagcggcaacgaaggtgttggcgataccgccgccgacaatcagctggtcagcgattttagacagggaatccagaacggtcagtttggtagatactttagaaccaccaacgatagccaccatcggacgagccggttctttcagcgctttacccagcgcatccagttcagcggccagcagcgggcctgcgcacgcaacatcagcaaatttgccgataccgtgggtagaagcctgcgcgcggtgcgcagtaccaaaggcgtccatcacgaatacgtcacacagggcggcgtattttttagacagcgcttcgtcgtctttcttttcgcctttgttaaagcgaacgttttccagaaccaccagctcaccttcggccacgtcaacgccgtccaggtaatctttgaccaggcgaaccgggttagacagtttgtctttcaggtagttaacaaccggcagcagagagaattcttcgttgtactcgccttcggtaggacgacccaggtgggaagttaccatcactttcgcgccctgtttcagagccagttcgatggtcggcagagaagcgcggatacgcgcgtcgctggtcactttcccttctttaacaggtacgttcagatccgcacggataaaaacgcgtttcccggccagatccagatcggtcatcttaattacagacatggtgaatcctctcaatgatgcttaaagttttgtcgacgctgacgcgtcgagcctgaaaccaactgcggccatcgctaacgtggtgtcgagcatcctgttagcaaagccccattcattatcgcaccagaccagcgtcttgatcaggtgggcgccactgacccgggtttgcgtgccatcaacaatggcgctgtgcgggtcgtggttaaaatctatcgagaccaacggtgattccgtatagtcaactataccatgaaatgcaccttgtgctgctttttgcagcaactggttgacttcactggcttttactggttttttcaccgttacgcttaaatcgatcgccgtcacattaatggttggaacgcgcaccgcaatcgcctcaaaacggtcgttaaactgcgggaatatacgcgtaatgcctgccgccagttttgtatctaccgggataatcgactggctggccgcgcgcgtgcgccgtagatcggagtgatacgcgtcgatcacctgctgatcgttcatcgcagagtggatcgtcgtgacggtaccagactcgatgccgtaagcatcatccaacaatttaatgacgggaattatgcaattcgtggtacaggacgcgtttgagacaatacgatgttccgcacgcagttggttctggttcacgccaaaaacgacggtggcgtcaagatcgttgctgcccggatgagaaaagagcactttcttcgcgccagcggcaatatgcgcctcgccatgctcccggttgccatatacgcccgtacaatccaacacaacatccacgcccagttcgcgccacggcagatccgccagcgttctttcatgcagaatacgaatgacatcgtcaccgacaaaaagctgctcgcgctcgtggcgaacctcccatgcaaaacgcccgtggctggtatcgtatttcaacaaatgcgccatgcctgcggcatccgccagctcgttgatggccaccacggtaatttccgcgcgacgtccggattcatacaaagcacgaaccacgttacgcccgatgcgaccaaagccattaatcgctatgcgtacggtcataggtctcctgcaaggctatcccgattcagatgaggctgacagagtaatgcagctcatcgtcgagtaaaacctcacctgtcgcaaactgcgactgattggttaattgtcgaacatttaattaactgaaacgcttcagctagaataagcgaaacggggaataaaaggaatgtttgtccagtcgaagaagacagttatctgacctgcatcacatttcatggccgcttacgctgcaatttattccatatttaagaatcaccagtacatccgtcagatcttttcatcgtcgcgtcacaaatactgatttatatcagaaagcgctgtcgccagcgtctatattatcagcgccacgtccgagtctcggagtcctgtaacgatgactgtatctcaccacaatgcctctacagcgcgcttttacgcgcttcgtctgcttcccggccaggaagtgttttcccaattacacgcctttgtgcaacagaaccaattacgtgccgcctggatagcagggtgtaccggcagtctgaccgatgttgcgctgcgttatgccgggcaagaggcgaccacatcgctcaccggcacgtttgaagttatctcgctaaacggcacgcttgaattgaccggcgagcatctgcatctcgcggtatcggatccctacggggttatgctcggcggccatatgatgccagggtgtaccgtgcgtaccacgctggaactggttatcggcgagctgccagcgctgacgttcagccgtcaaccgtgcgccatttccggttatgacgaactgcatatttcttcccgttaattgacgactctttaagaggtactttatggcgcgtcgcccgttttccagccagtccctggtgctgattgtcatcgctattgccatcaatatgattggcggacagcttattagcatgttgaagctgcctatttttctcgactcgatcggcaccttaattagcgcggtgctgttagggccgttcatcggcatgttgactgggcttctaaccaacttgctgtgggggctgcttaccgatcctatcgctgccgcgtttgccccggtagcgatggttatcggtctggtcgccgggtggctggcgcgcgcaggctggtttcgtaccctgcccaaagtgatcgtcagcggggtcgtcattacgttagcggtgacgctggtcgccgtaccgcttcgtaccgcgctttttggcggcgttaccggcagcggcgctgatttattcgtcgcctggatgcattcaatgggccaaaacctggtggagtcggtcgcgattaccgtcataggcgctaatctggtcgataaaattctgacggcgatcatcgtttgggtgctgctgcgtcagctaccgttacgtacgacacggcattttcctgcgatgtcagccgtacgctaaatgcatccgtttacctcgttaaccttatgggcgctggcggcctgcaccacgctgctactccctgcgcagaccgtgctcccggtttatagcgcggcggccttcctctgtctgctggcgctgaaatcaacgcggcggcgggcgaagtatgtcgcctggctgatgctgtctttagggtttgggctatggctggtacatggcggttggctaacggaatggataagcgggcagcctcgcgatccgcagcgctgggtatatgccgttacgctatggctacgtctgctggcgatcgtgtcgacgtcgcagctatggatgcagtatgtgccggttcagcggtttattcgcgccctgttcgcttcacgtctgccgcccggcatcgcttacctgttcgctggccctctgctggtcgtcgaacagctcaaacgacaactgacgatcgttcatgaagcccagcgcgcgcgtggcgtaccgctggatgaaggctggtatcagcggctacgggcaatgcctgcgctgatcgtgccgcttacgcaaaatgcgcttaacgatctgacaatacgcggcgcggcgttggatatgcgggggtttcggctgcatcgagcccgaaccacgctgtgggcgccgaaagatagcgtgttacaacgggttgcgcggtatggcatggtactgctaatactggcggaagcgggagtatggatatggttacgttagagcagtttcgttatcttccgtccgatgcgacacgcccgccggcatgttttgatttccactattcaacacccggaatagtggcgatagtcggcgataacggcagcggaaaaagtacgctggcgcaactgatggctggctggtatccggattatctccccggtgatattgacggcacaggcttactgcttggcgtccctatcgggcggctcccgctggtagaacagtcgcccaccatccaattggtgcagcaatcgccttatttacagctttccggctgtacctttagcgtagaggaagaggtggcgtttggcccggagaatctcggcctccatgaagcggagattctacggcgcattgacgaggcgctgaccctgacaaactgccagtcgttacgccatcgccatcccggcacgctctccggcggcgaaacgcagcgggtagtaattgccagcgcgcttgccatgcagcccagactgttaattcttgatgaagccttcagtcggctgacgtcagcggccaccgggatgctgctggaacggttacaacagtgggcgctggaacgtcattctctcattgtgctttttgagcgtaatcattttccttttctgacgcgatgccagcgggtatggcaattgcgcgacggagcgctaaccccattatgttgacgttaaatcaggtcgcttatcgctggccggatgccgcagccgactgtttgcacgctatctcgcttaaacttcgtgacggcgaatggctggcgttgaccggcgataacggcgcgggaaaatcaacgctgttacggattatggccggcctgctttcccccgcttccggctcggtaacgcttaatggagagccgattgcgcagcttaaaaatcgtcaacgcgccgccgctatcggcgtactctttcaggaagcggaaaaccagattttccacagcaatgtcgcgcaagaggtcgcttttgggctgaaactacaacgcttatcggcggaggaaatttcacggcgcacgcaggccgcgctgcggttatgccagctaacggacgtcgccgaggcacacccgcttgatctgcacgccgcacagcgccggatggtggcggtcgccagtctggaggcgatagcgccgcctgtgttattgctggatgaacccagccgggattttgacgcccactggctaaccgtatttgaacactggctggcgacatgccgggcacggggaaccagcgtcgtcgcgattagccatgacgctgcgtttacccggcgtcatttttcacgggtggtacggctggaaaacggcaggttgtcaaagggagaataaaaaacgggtcgccgaagcgacccgttttatgccgtattaaggattacagcagtgctttcgctttggcgatcacgttgtccaccgtgaagccaaactcttcaaacaacagctctgccggagcagactcaccgaaggtggtcatcccgacaatagcgccgttcaggccgacgtatttgaaccagtagtcagcgatacccgcttcaatcgccacacgcgcagagaccgccttcggcagcacggattcacggtaagccgcatcctgcttgtcgaacgcgtcggtggacggcatggaaaccacgcgcgccttcacgccttcggcagtcagtttttcgtaagcggcaaccgccagctcaacctctgaaccggtcgcaatgaagataatctgcggctggcccgcacaatctttcagtacgtaaccaccgcgggcgatattcgccagttgctcttcagtacgttcctgctgcgccaggttctgacgggagaggatcagcgcggttgggccatcctgacgctctacgccatatttccacgccaccgcggattccacctggtcgcacggacgccatgtggacatgttcggcgttacgcgcaggcttgccacctgctcgaccggctggtgcgtcgggccatcttcgcccagaccgatggagtcgtgggtgtacaccatcacctgacgttgtttcatcaacgctgccatacgcactgcgttacgggcatattcgacgaacatcaggaaggtggaggtgtacggcaggaaaccgccgtgcagggcgataccgttggcgatagcggtcataccgaattcgcgcacaccgtaatgaatgtagttacctgcggcatcttcgttaatcgctttcgaaccggaccacagggtcaggttagaaggagccaggtcagcggagccgccgaggaattccggcaacagcggaccgaaggcttcgatggtattctgggacgctttacggctggcgattttggatggattcgcctgcagtttagcgatgaactcattcgctttcgcatcgaagtcagccggcatgtcgcctttcatacgacgagtgaattcagcagcttcctgcgggaaggctttctcataagccgcgaatttctcattccatgcagactctttcgcctggccggcttctttcgcatcccactgggcgtagatttcagacgggatttcgaacggcgcgtatttccagcccaactgttcgcgggtcagcgcgatttccgcgtcgcccagcggcgcgccgtgggaatcgtgggtaccctgtttgttcggcgaaccgaaaccgatgatggttttgcacatcagcagggacggtttgtcagtcacggcgcgagcttcttccgtggcgcgtttaatggcgtcggcatcgtgaccgtcaatgccacggataacgtgccagccgtaggcttcaaaacgtttcgcggtgtcatcggtgaaccagccttcaacatgaccatcgatagagataccgttgtcatcatagaacgcgatcagtttgcccagtttcagagtaccagccagagagcacacttcgtgagaaatgccttccatcatgcagccgtcgcccataaagacgtaggtgaagtggtcaacgatatcgtggccaggacgattaaactgcgccgccagagttttctcggcaatcgccatcccgacggcgttggcaataccctgacccagcgggccagtagtggtttcaacgccagcggtgtagcccacttccgggtgaccaggggtttttgaatgtagctgacggaaattctgcagctcggacatcggcaggtcataaccggtgaggtgcagcaggctgtaaatcagcattgagccgtggccattggacagcacgaagcggtcgcggtcggcccaggacgggttggtcgggttgtggttcaggaaatcacgccacaggacttcggcaatgtcagccatacccatcggggcacccgggtgacc
